United States Patent
Krieg et al.

(10) Patent No.: US 10,059,941 B2
(45) Date of Patent: Aug. 28, 2018

(54) COMPOSITIONS AND METHODS FOR MODULATING SMN GENE FAMILY EXPRESSION

(71) Applicants: Translate Bio MA, Inc., Lexington, MA (US); The General Hospital Corporation d/b/a Massachusetts General Hospital, Boston, MA (US)

(72) Inventors: Arthur M. Krieg, Cambridge, MA (US); Romesh Subramanian, Framingham, MA (US); James McSwiggen, Arlington, MA (US); Jeannie T. Lee, Boston, MA (US)

(73) Assignees: Translate Bio MA, Inc., Lexington, MA (US); The General Hospital Corporation, Boston, MA (US)

( * ) Notice: Subject to any disclaimer, the term of this patent is extended or adjusted under 35 U.S.C. 154(b) by 0 days.

(21) Appl. No.: 14/401,194

(22) PCT Filed: May 16, 2013

(86) PCT No.: PCT/US2013/041440
§ 371 (c)(1),
(2) Date: Nov. 14, 2014

(87) PCT Pub. No.: WO2013/173638
PCT Pub. Date: Nov. 21, 2013

(65) Prior Publication Data
US 2015/0252364 A1   Sep. 10, 2015

Related U.S. Application Data

(60) Provisional application No. 61/785,529, filed on Mar. 14, 2013, provisional application No. 61/719,394, filed on Oct. 27, 2012, provisional application No. 61/647,858, filed on May 16, 2012.

(51) Int. Cl.
| | | |
|---|---|---|
| *C12N 15/113* | (2010.01) | |
| *A61K 31/7125* | (2006.01) | |
| *A61K 31/7115* | (2006.01) | |
| *A61K 31/712* | (2006.01) | |
| *A61K 31/7088* | (2006.01) | |
| *C07H 21/00* | (2006.01) | |

(52) U.S. Cl.
CPC ........ *C12N 15/113* (2013.01); *A61K 31/7088* (2013.01); *C07H 21/00* (2013.01); *C12N 2310/11* (2013.01); *C12N 2310/315* (2013.01); *C12N 2310/3231* (2013.01); *C12N 2310/343* (2013.01); *C12N 2310/3517* (2013.01)

(58) Field of Classification Search
None
See application file for complete search history.

(56) References Cited

U.S. PATENT DOCUMENTS

| | | | |
|---|---|---|---|
| 4,725,677 A | 2/1988 | Köster et al. | |
| 5,491,133 A | 2/1996 | Walder et al. | |
| 5,576,208 A | 11/1996 | Monia et al. | |
| 5,623,065 A | 4/1997 | Cook et al. | |
| 5,652,355 A | 7/1997 | Metelev et al. | |
| 5,661,134 A | 8/1997 | Cook et al. | |
| 5,912,332 A | 6/1999 | Agrawal et al. | |
| 5,914,396 A | 6/1999 | Cook et al. | |
| 5,919,619 A | 7/1999 | Tullis | |
| 5,965,722 A | 10/1999 | Ecker et al. | |
| 5,976,879 A | 11/1999 | Kole et al. | |
| 6,015,710 A | 1/2000 | Shay et al. | |
| 6,040,142 A | 3/2000 | Melki et al. | |
| 6,046,307 A | 4/2000 | Shay et al. | |
| 6,063,400 A | 5/2000 | Geho et al. | |
| 6,080,577 A | 6/2000 | Melki et al. | |
| 6,107,094 A | 8/2000 | Crooke | |
| 6,143,881 A | 11/2000 | Metelev et al. | |
| 6,146,829 A | 11/2000 | Cook et al. | |
| 6,187,545 B1 * | 2/2001 | McKay .............. | C12N 15/1137 435/325 |
| 6,197,944 B1 | 3/2001 | Walder et al. | |
| 6,210,892 B1 | 4/2001 | Bennett et al. | |
| 6,294,650 B1 | 9/2001 | Shay et al. | |
| 6,326,199 B1 | 12/2001 | Cook et al. | |
| 6,346,614 B1 | 2/2002 | Metelev et al. | |

(Continued)

FOREIGN PATENT DOCUMENTS

| | | |
|---|---|---|
| CA | 2805791 A1 | 1/2012 |
| EP | 0 999 270 A1 | 5/2000 |

(Continued)

OTHER PUBLICATIONS

Taylor et al. Drug Discovery Today 1999, vol. 4, pp. 562-567.*

(Continued)

*Primary Examiner* — Tracy Vivlemore
(74) *Attorney, Agent, or Firm* — Wolf, Greenfield & Sacks, P.C.

(57) ABSTRACT

Aspects of the invention provide single stranded oligonucleotides for activating or enhancing expression of SMN1 or SMN2. Further aspects provide compositions and kits comprising single stranded oligonucleotides for activating or enhancing expression of SMN1 or SMN2 that comprises exon 7. Methods for modulating expression of SMN1 or SMN2 using the single stranded oligonucleotides are also provided. Further aspects of the invention provide methods for selecting a candidate oligonucleotide for activating or enhancing expression of SMN1 or SMN2.

38 Claims, 12 Drawing Sheets

Specification includes a Sequence Listing.

(56) References Cited

U.S. PATENT DOCUMENTS

| | | |
|---|---|---|
| 6,359,124 B1 | 3/2002 | Ecker et al. |
| 6,395,492 B1 | 5/2002 | Manoharan et al. |
| 6,451,991 B1 | 9/2002 | Martin et al. |
| 6,503,754 B1 | 1/2003 | Zhang et al. |
| 6,531,584 B1 | 3/2003 | Cook et al. |
| 6,608,035 B1 | 8/2003 | Agrawal et al. |
| 6,677,445 B1 | 1/2004 | Innis et al. |
| 6,727,355 B2 | 4/2004 | Matsuo et al. |
| 6,753,423 B1 | 6/2004 | Cook et al. |
| 6,794,499 B2 * | 9/2004 | Wengel .................. C07H 21/00 536/22.1 |
| 6,831,166 B2 | 12/2004 | Manoharan et al. |
| 6,919,439 B2 | 7/2005 | Manoharan et al. |
| 7,015,315 B1 | 3/2006 | Cook et al. |
| 7,033,752 B1 | 4/2006 | Melki et al. |
| 7,041,816 B2 | 5/2006 | Ravikumar et al. |
| 7,045,609 B2 | 5/2006 | Metelev et al. |
| 7,226,785 B2 | 6/2007 | Kmiec et al. |
| 7,374,927 B2 | 5/2008 | Palma et al. |
| 7,449,297 B2 * | 11/2008 | Freije .................. C12Q 1/6827 435/6.12 |
| 7,655,785 B1 | 2/2010 | Bentwich |
| 7,683,036 B2 | 3/2010 | Esau et al. |
| 7,687,616 B1 | 3/2010 | Bentwich et al. |
| 7,687,617 B2 | 3/2010 | Thrue et al. |
| 7,709,456 B2 | 5/2010 | Corey et al. |
| 7,838,657 B2 | 11/2010 | Singh et al. |
| 7,858,592 B2 | 12/2010 | Shames et al. |
| 7,879,992 B2 | 2/2011 | Vickers et al. |
| 7,888,012 B2 | 2/2011 | Iversen et al. |
| 7,960,541 B2 | 6/2011 | Wilton et al. |
| 8,067,569 B2 | 11/2011 | Iversen et al. |
| 8,092,992 B2 | 1/2012 | Kuwabara et al. |
| 8,110,560 B2 | 2/2012 | Singh et al. |
| 8,129,515 B2 | 3/2012 | Esau et al. |
| 8,153,365 B2 | 4/2012 | Wengel et al. |
| 8,153,602 B1 | 4/2012 | Bennett et al. |
| 8,153,606 B2 | 4/2012 | Collard et al. |
| 8,222,221 B2 | 7/2012 | Corey et al. |
| 8,232,384 B2 | 7/2012 | Wilton et al. |
| 8,288,354 B2 | 10/2012 | Wahlestedt |
| 8,288,356 B2 | 10/2012 | Obad et al. |
| 8,318,690 B2 | 11/2012 | Collard et al. |
| 8,361,977 B2 | 1/2013 | Baker et al. |
| 8,361,980 B2 | 1/2013 | Kauppinen et al. |
| 8,404,659 B2 | 3/2013 | Kauppinen et al. |
| 8,415,313 B2 | 4/2013 | Mourich et al. |
| 8,846,639 B2 | 9/2014 | Swayze et al. |
| 9,328,346 B2 | 5/2016 | Lee et al. |
| 9,567,581 B2 | 2/2017 | Lee et al. |
| 9,593,330 B2 | 3/2017 | Collard et al. |
| 2002/0160379 A1 | 10/2002 | Cook et al. |
| 2003/0198983 A1 | 10/2003 | Zhou |
| 2003/0208061 A1 * | 11/2003 | Manoharan ............ C07H 21/00 536/25.3 |
| 2003/0219770 A1 * | 11/2003 | Eshleman ............. C12Q 1/6869 435/6.14 |
| 2003/0235822 A1 | 12/2003 | Lokhov et al. |
| 2004/0002153 A1 | 1/2004 | Monia et al. |
| 2004/0038274 A1 | 2/2004 | Cook et al. |
| 2004/0096848 A1 | 5/2004 | Thrue et al. |
| 2004/0241651 A1 | 12/2004 | Olek et al. |
| 2004/0248840 A1 | 12/2004 | Hansen et al. |
| 2005/0003369 A1 | 1/2005 | Christians et al. |
| 2005/0026160 A1 * | 2/2005 | Allerson ................ C07H 21/00 435/6.11 |
| 2005/0054836 A1 | 3/2005 | Krainer et al. |
| 2005/0100923 A1 * | 5/2005 | Dreyfuss .............. C07K 14/475 435/6.11 |
| 2005/0108783 A1 * | 5/2005 | Koike .................. A01K 67/0276 800/17 |
| 2005/0130924 A1 | 6/2005 | Monia et al. |
| 2005/0164209 A1 | 7/2005 | Bennett et al. |
| 2005/0176025 A1 | 8/2005 | McSwiggen et al. |
| 2005/0203042 A1 | 9/2005 | Frieden et al. |
| 2005/0226848 A1 | 10/2005 | Kuwabara et al. |
| 2005/0233455 A1 | 10/2005 | Damha et al. |
| 2005/0244851 A1 | 11/2005 | Blume et al. |
| 2005/0246794 A1 | 11/2005 | Khvorova et al. |
| 2005/0261218 A1 | 11/2005 | Esau et al. |
| 2005/0272080 A1 | 12/2005 | Palma et al. |
| 2006/0003322 A1 | 1/2006 | Bentwich |
| 2006/0046260 A1 | 3/2006 | Kriksunov et al. |
| 2006/0089490 A1 | 4/2006 | Melki et al. |
| 2006/0128646 A1 | 6/2006 | Christensen et al. |
| 2006/0270624 A1 | 11/2006 | Cook et al. |
| 2007/0032446 A1 | 2/2007 | Cook et al. |
| 2007/0042380 A1 | 2/2007 | Bentwich et al. |
| 2007/0111963 A1 | 5/2007 | Corey et al. |
| 2007/0166737 A1 | 7/2007 | Melki et al. |
| 2007/0191294 A1 | 8/2007 | Elmen et al. |
| 2007/0269815 A1 | 11/2007 | Rivory et al. |
| 2007/0292408 A1 | 12/2007 | Singh et al. |
| 2008/0015162 A1 | 1/2008 | Bhanot et al. |
| 2008/0176793 A1 | 7/2008 | Simons et al. |
| 2008/0194463 A1 | 8/2008 | Weller et al. |
| 2008/0242629 A1 | 10/2008 | Crooke et al. |
| 2008/0249039 A1 | 10/2008 | Elmen et al. |
| 2008/0293655 A1 | 11/2008 | Aygun et al. |
| 2008/0318895 A1 | 12/2008 | Lee et al. |
| 2009/0082297 A1 | 3/2009 | Lioy et al. |
| 2009/0092988 A1 | 4/2009 | Schwartz et al. |
| 2009/0099066 A1 * | 4/2009 | Moulton ................ C12N 15/87 514/1.1 |
| 2009/0099109 A1 | 4/2009 | Shames et al. |
| 2009/0143326 A1 | 6/2009 | Obad et al. |
| 2009/0155910 A1 | 6/2009 | McGonigle |
| 2009/0221685 A1 | 9/2009 | Esau et al. |
| 2009/0258925 A1 | 10/2009 | Wahlestedt |
| 2009/0324549 A1 | 12/2009 | Battaglia et al. |
| 2009/0325868 A1 | 12/2009 | Liu et al. |
| 2009/0326051 A1 | 12/2009 | Corey et al. |
| 2010/0004314 A1 | 1/2010 | Dondero et al. |
| 2010/0021914 A1 | 1/2010 | Moeller et al. |
| 2010/0087511 A1 | 4/2010 | Singh et al. |
| 2010/0105760 A1 | 4/2010 | Collard et al. |
| 2010/0111982 A1 | 5/2010 | Zang et al. |
| 2010/0112042 A1 | 5/2010 | Polisky et al. |
| 2010/0124547 A1 | 5/2010 | Bramlage et al. |
| 2010/0143359 A1 | 6/2010 | Ebert et al. |
| 2010/0197762 A1 | 8/2010 | Swayze et al. |
| 2010/0210707 A1 | 8/2010 | Li et al. |
| 2010/0210712 A1 | 8/2010 | Hansen et al. |
| 2010/0216238 A1 * | 8/2010 | Baker .................. C12N 15/111 435/375 |
| 2010/0247543 A1 | 9/2010 | Maes et al. |
| 2010/0256223 A1 | 10/2010 | Moeller et al. |
| 2010/0280100 A1 | 11/2010 | Collard et al. |
| 2010/0286141 A1 | 11/2010 | Durden et al. |
| 2010/0317606 A1 | 12/2010 | Chan et al. |
| 2011/0039910 A1 | 2/2011 | Crooke et al. |
| 2011/0077286 A1 | 3/2011 | Damha et al. |
| 2011/0086833 A1 | 4/2011 | Paushkin et al. |
| 2011/0150868 A1 | 6/2011 | Yu et al. |
| 2011/0159587 A1 | 6/2011 | Krainer et al. |
| 2011/0172292 A1 | 7/2011 | Hansen et al. |
| 2011/0191912 A1 | 8/2011 | Alexandrov |
| 2011/0207217 A1 | 8/2011 | Corey et al. |
| 2011/0237606 A1 | 9/2011 | Chai et al. |
| 2011/0237649 A1 | 9/2011 | Collard et al. |
| 2011/0237650 A1 | 9/2011 | Collard et al. |
| 2011/0237651 A1 | 9/2011 | Collard et al. |
| 2011/0251261 A1 | 10/2011 | Burnett et al. |
| 2011/0263687 A1 | 10/2011 | Mattick et al. |
| 2011/0294870 A1 | 12/2011 | Collard et al. |
| 2011/0319283 A1 | 12/2011 | Thompson |
| 2011/0319317 A1 | 12/2011 | Collard et al. |
| 2011/0319475 A1 | 12/2011 | Collard et al. |
| 2011/0319476 A1 | 12/2011 | Collard et al. |
| 2012/0004184 A1 | 1/2012 | Collard et al. |
| 2012/0004278 A1 | 1/2012 | Chang et al. |
| 2012/0010156 A1 | 1/2012 | Collard et al. |
| 2012/0046236 A1 | 2/2012 | Collard et al. |

(56) References Cited

U.S. PATENT DOCUMENTS

| | | |
|---|---|---|
| 2012/0046344 A1 | 2/2012 | Collard et al. |
| 2012/0046345 A1 | 2/2012 | Collard et al. |
| 2012/0064048 A1 | 3/2012 | Collard et al. |
| 2012/0071418 A1 | 3/2012 | Copeland et al. |
| 2012/0083596 A1 | 4/2012 | Elmen et al. |
| 2012/0088817 A1 | 4/2012 | Collard et al. |
| 2012/0094934 A1 | 4/2012 | Collard et al. |
| 2012/0095079 A1 | 4/2012 | Collard et al. |
| 2012/0095081 A1 | 4/2012 | Collard et al. |
| 2012/0129917 A1 | 5/2012 | Collard et al. |
| 2012/0135941 A1 | 5/2012 | Collard et al. |
| 2012/0142610 A1 | 6/2012 | Collard et al. |
| 2012/0142758 A1 | 6/2012 | Collard et al. |
| 2012/0149756 A1 | 6/2012 | Schumperli et al. |
| 2012/0149759 A1 | 6/2012 | Collard et al. |
| 2012/0157333 A1 | 6/2012 | Kauppinen et al. |
| 2012/0171170 A1 | 7/2012 | Collard et al. |
| 2012/0252869 A1 | 10/2012 | Collard et al. |
| 2012/0264812 A1 | 10/2012 | Collard et al. |
| 2012/0277290 A1 | 11/2012 | Collard et al. |
| 2012/0288869 A1 | 11/2012 | Schwartz et al. |
| 2012/0289581 A1 | 11/2012 | Chang et al. |
| 2012/0289583 A1 | 11/2012 | Collard et al. |
| 2012/0295952 A1 | 11/2012 | Collard et al. |
| 2012/0295953 A1 | 11/2012 | Colaird et al. |
| 2012/0295954 A1 | 11/2012 | Collard et al. |
| 2012/0295959 A1 | 11/2012 | Collard et al. |
| 2012/0309814 A1 | 12/2012 | Collard et al. |
| 2012/0322851 A1 | 12/2012 | Hardee et al. |
| 2012/0322853 A1 | 12/2012 | Collard et al. |
| 2012/0329727 A1 | 12/2012 | Collard et al. |
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0116300 A1 | 5/2013 | Collard et al. |
| 2013/0137751 A1 | 5/2013 | Collard et al. |
| 2013/0143946 A1 | 6/2013 | Collard et al. |
| 2013/0164846 A1 | 6/2013 | Saestrom |
| 2013/0184325 A9 | 7/2013 | Collard et al. |
| 2013/0210893 A1 | 8/2013 | Collard et al. |
| 2013/0245095 A1 | 9/2013 | Collard et al. |
| 2013/0245099 A1 | 9/2013 | Collard et al. |
| 2013/0253036 A1 | 9/2013 | Collard et al. |
| 2013/0261065 A1 | 10/2013 | Collard et al. |
| 2014/0142160 A1 | 5/2014 | Lee et al. |
| 2014/0187606 A1 | 7/2014 | Collard et al. |
| 2015/0099791 A1 | 4/2015 | Krieg et al. |
| 2015/0133362 A1 | 5/2015 | Krieg et al. |
| 2015/0133528 A1 | 5/2015 | Krieg et al. |
| 2015/0133529 A1 | 5/2015 | Krieg et al. |
| 2015/0141320 A1 | 5/2015 | Krieg et al. |
| 2015/0152410 A1 | 6/2015 | Krieg et al. |
| 2015/0159160 A1 | 6/2015 | Krieg et al. |
| 2015/0159161 A1 | 6/2015 | Krieg et al. |
| 2015/0191722 A1 | 7/2015 | Krieg et al. |
| 2015/0218560 A1 | 8/2015 | Krieg et al. |
| 2015/0225717 A1 | 8/2015 | Lee et al. |
| 2015/0252364 A1 | 9/2015 | Krieg et al. |
| 2017/0037396 A1 | 2/2017 | Lee et al. |

FOREIGN PATENT DOCUMENTS

| | | | |
|---|---|---|---|
| EP | 1 044 987 A2 | 10/2000 | |
| EP | 1 752 536 A1 | 5/2005 | |
| EP | 1 695 979 A2 | 8/2006 | |
| EP | 1 957 648 B1 | 11/2006 | |
| EP | 1 967 525 A2 | 9/2008 | |
| EP | 2 021 472 B1 | 6/2011 | |
| EP | 2 023 940 B1 | 6/2011 | |
| EP | 2 431 467 A2 | 3/2012 | |
| EP | 2 431 467 A3 | 5/2012 | |
| EP | 2 591 797 A1 | 5/2013 | |
| JP | 04-320700 | 11/1992 | |
| JP | 3420984 B2 | 6/2003 | |
| JP | 2006-522597 | 10/2006 | |
| JP | 2008-044958 A | 2/2008 | |
| JP | 2009-536037 | 10/2009 | |
| JP | 2010-507579 A | 3/2010 | |
| JP | 2010-516256 | 5/2010 | |
| JP | 11-033863 A | 2/2011 | |
| JP | 2015-518714 | 7/2015 | |
| KR | 10-2011-0050134 A | 5/2011 | |
| WO | WO 89/05358 A1 | 6/1989 | |
| WO | WO 92/00386 A1 | 1/1992 | |
| WO | WO 93/13121 A1 | 7/1993 | |
| WO | WO 94/02499 A1 | 2/1994 | |
| WO | WO 94/17093 A1 | 8/1994 | |
| WO | WO 95/33852 A1 | 12/1995 | |
| WO | WO 2001/007662 A1 | 2/2001 | |
| WO | WO 01/36627 A2 | 5/2001 | |
| WO | WO 01/66129 A1 | 9/2001 | |
| WO | WO 01/72765 A1 | 10/2001 | |
| WO | WO 2001/90341 A1 | 11/2001 | |
| WO | WO 02/038738 A2 | 5/2002 | |
| WO | WO 02/103015 A2 | 12/2002 | |
| WO | WO 2004/011613 A2 | 2/2004 | |
| WO | WO 2004/092356 A2 | 10/2004 | |
| WO | WO 2004/099382 A2 | 11/2004 | |
| WO | WO 2004/113867 A2 | 12/2004 | |
| WO | WO 2005/042018 A2 | 5/2005 | |
| WO | WO 2005/044091 A2 | 5/2005 | |
| WO | WO 2005/044981 A2 | 5/2005 | |
| WO | WO 2005/061710 A1 | 7/2005 | |
| WO | WO 2005/089169 A2 | 9/2005 | |
| WO | WO 2005/094370 A2 | 10/2005 | |
| WO | WO 2006/063356 A1 | 6/2006 | |
| WO | WO 2006/130201 A1 | 12/2006 | |
| WO | WO 2007/002390 A2 | 1/2007 | |
| WO | WO 2007/031091 A2 | 3/2007 | |
| WO | WO 2007/076328 A2 | 7/2007 | |
| WO | WO 2007/086990 A2 | 8/2007 | |
| WO | WO 2007/086990 A3 | 8/2007 | |
| WO | WO 2007/115578 A1 | 10/2007 | |
| WO | WO 2007/131237 A2 | 11/2007 | |
| WO | WO 2007/133812 A2 | 11/2007 | |
| WO | WO 2008/024499 A2 | 2/2008 | |
| WO | WO 2008/025069 A1 | 3/2008 | |
| WO | WO 2008/029619 A1 | 3/2008 | |
| WO | WO 2008/061537 A2 | 5/2008 | |
| WO | WO 2008/103761 A2 | 8/2008 | |
| WO | WO 2008/103763 A2 | 8/2008 | |
| WO | WO 2008/113832 A2 | 9/2008 | |
| WO | WO 2008/141282 A2 | 11/2008 | |
| WO | WO 2009/043353 A2 | 4/2009 | |
| WO | WO 2009/044383 A1 | 4/2009 | |
| WO | WO 2009/046397 A2 | 4/2009 | |
| WO | WO 2009/061851 A2 | 5/2009 | |
| WO | WO 2009/064920 A2 | 5/2009 | |
| WO | WO 2009/090182 A1 | 7/2009 | |
| WO | WO 2009/124341 A1 | 10/2009 | |
| WO | WO 2009/134710 A2 | 11/2009 | |
| WO | WO 2009/149182 A1 | 12/2009 | |
| WO | WO 2009/151546 A2 | 12/2009 | |
| WO | WO 2010/000665 A1 | 1/2010 | |
| WO | WO 2010/014592 A1 | 2/2010 | |
| WO | WO 2010/065671 A2 | 6/2010 | |
| WO | WO 2010/065787 A2 | 6/2010 | |
| WO | WO 2010/083615 A1 | 7/2010 | |
| WO | WO 2010/093860 A2 | 8/2010 | |
| WO | WO 2010/093904 A2 | 8/2010 | |
| WO | WO 2010/102058 A2 | 9/2010 | |
| WO | WO 2010/107733 A2 | 9/2010 | |
| WO | WO 2010/124231 A2 | 10/2010 | |
| WO | WO 2010/129746 A2 | 11/2010 | |
| WO | WO 2010/129799 A2 | 11/2010 | |
| WO | WO 2010/129861 A2 | 11/2010 | |
| WO | WO 2010/135329 A2 | 11/2010 | |

(56) References Cited

FOREIGN PATENT DOCUMENTS

| | | |
|---|---|---|
| WO | WO 2010/135695 A2 | 11/2010 |
| WO | WO 2010/138806 A2 | 12/2010 |
| WO | WO 2010/148050 A2 | 12/2010 |
| WO | WO 2010/148065 A2 | 12/2010 |
| WO | WO 2010/151671 A2 | 12/2010 |
| WO | WO 2010/151674 A2 | 12/2010 |
| WO | WO 2011/005786 A2 | 1/2011 |
| WO | WO 2011/009624 A1 | 1/2011 |
| WO | WO 2011/010706 A1 | 1/2011 |
| WO | WO 2011/017516 A2 | 2/2011 |
| WO | WO 2011/019815 A2 | 2/2011 |
| WO | WO 2011/022606 A2 | 2/2011 |
| WO | WO 2011/025862 A2 | 3/2011 |
| WO | WO 2011/031482 A2 | 3/2011 |
| WO | WO 2011/032109 A1 | 3/2011 |
| WO | WO 2011/038205 A2 | 3/2011 |
| WO | WO 2011/038210 A2 | 3/2011 |
| WO | WO 2011/048125 A1 | 4/2011 |
| WO | WO 2011/079261 A2 | 6/2011 |
| WO | WO 2011/079263 A2 | 6/2011 |
| WO | WO 2011/082409 A2 | 7/2011 |
| WO | WO 2011/084455 A2 | 7/2011 |
| WO | WO 2011/085066 A2 | 7/2011 |
| WO | WO 2011/097388 A1 | 8/2011 |
| WO | WO 2011/097582 A2 | 8/2011 |
| WO | WO 2011/097641 A1 | 8/2011 |
| WO | WO 2011/123745 A2 | 10/2011 |
| WO | WO 2011/139387 A1 | 11/2011 |
| WO | WO 2011/146674 A2 | 11/2011 |
| WO | WO 2011/146675 A2 | 11/2011 |
| WO | WO 2011/150005 A2 | 12/2011 |
| WO | WO 2011/159836 A2 | 12/2011 |
| WO | WO 2011/161460 A2 | 12/2011 |
| WO | WO 2011/163499 A2 | 12/2011 |
| WO | WO 2012/009347 A2 | 1/2012 |
| WO | WO 2012/009402 A2 | 1/2012 |
| WO | WO 2012/018881 A2 | 2/2012 |
| WO | WO 2012/024478 A2 | 2/2012 |
| WO | WO 2012/027033 A1 | 3/2012 |
| WO | WO 2012/047956 A2 | 4/2012 |
| WO | WO 2012/054723 A2 | 4/2012 |
| WO | WO 2012/058268 A2 | 5/2012 |
| WO | WO 2012/064806 A2 | 5/2012 |
| WO | WO 2012/065143 A1 | 5/2012 |
| WO | WO 2012/068340 A2 | 5/2012 |
| WO | WO 2012/071238 A2 | 5/2012 |
| WO | WO 2012/087983 A1 | 6/2012 |
| WO | WO 2012/109476 A2 | 8/2012 |
| WO | WO 2012/144220 A1 | 10/2012 |
| WO | WO 2012/170771 A1 | 12/2012 |
| WO | WO 2012/174610 A1 | 12/2012 |
| WO | WO 2013/006619 A1 | 1/2013 |
| WO | WO 2013/036403 A1 | 3/2013 |
| WO | WO 2013/040429 A1 | 3/2013 |
| WO | WO 2013/124807 A2 | 8/2013 |
| WO | WO 2013/138374 A2 | 9/2013 |
| WO | WO 2013/173598 A1 | 11/2013 |
| WO | WO 2013/173599 A1 | 11/2013 |
| WO | WO 2013/173601 A1 | 11/2013 |
| WO | WO 2013/173605 A1 | 11/2013 |
| WO | WO 2013/173608 A1 | 11/2013 |
| WO | WO 2013/173635 A1 | 11/2013 |
| WO | WO 2013/173637 A1 | 11/2013 |
| WO | WO 2013/173638 A1 | 11/2013 |
| WO | WO 2013/173645 A1 | 11/2013 |
| WO | WO 2013/173647 A1 | 11/2013 |
| WO | WO 2013/173652 A1 | 11/2013 |
| WO | WO 2014/043544 A1 | 3/2014 |
| WO | WO 2014/076195 A1 | 5/2014 |
| WO | WO 2014/172698 A1 | 10/2014 |
| WO | WO 2014/197826 A1 | 12/2014 |
| WO | WO 2014/203518 A1 | 12/2014 |
| WO | WO 2015/035476 A1 | 3/2015 |

OTHER PUBLICATIONS

GenBank accession No. AM773775 [online] submitted Jul. 13, 2007 [retrieved on Jun. 27, 2016] Retrieved from the internet: <URL: http://www.ncbi.nlm.nih.gov/nuccore/AM773775>.*
International Search Report and Written Opinion for Application No. PCT/US2013/041440 dated Jul. 29, 2013.
International Preliminary Report on Patentability for Application No. PCT/US2013/041440 dated Nov. 27, 2014.
International Preliminary Report on Patentability for Application No. PCT/US2013/041452 dated Nov. 27, 2014.
International Preliminary Report on Patentability for Application No. PCT/US2013/041382 dated Nov. 27, 2014.
International Preliminary Report on Patentability for Application No. PCT/US2013/041381 dated Nov. 27, 2014.
International Preliminary Report on Patentability for Application No. PCT/US2013/041455 dated Nov. 27, 2014.
International Preliminary Report on Patentability for Application No. PCT/US2013/041389 dated Nov. 27, 2014.
International Preliminary Report on Patentability for Application No. PCT/US2013/041385 dated Nov. 27, 2014.
International Preliminary Report on Patentability for Application No. PCT/US2013/041394 dated Nov. 27, 2014.
International Preliminary Report on Patentability for Application No. PCT/US2013/041434 dated Nov. 27, 2014.
International Preliminary Report on Patentability for Application No. PCT/US2013/041437 dated Nov. 27, 2014.
International Search Report and Written Opinion for Application No. PCT/US2013/041461 dated Aug. 21, 2013.
International Preliminary Report on Patentability for Application No. PCT/US2013/041461 dated Nov. 27, 2014.
International Search Report and Written Opinion for Application No. PCT/US2012/055535 dated Feb. 26, 2013.
International Search Report and Written Opinion for Application No. PCT/US2014/041345 dated Oct. 14, 2014.
International Search Report and Written Opinion for Application No. PCT/US2014/059111 dated Jan. 13, 2015.
Extended European Search Report for Application No. EP 11840099.3 dated Oct. 7, 2014.
International Search Report and Written Opinion for Application No. PCT/US2011/060493 dated Apr. 18, 2012.
European Search Report for Application No. EP 11852141.8 dated Jan. 19, 2015.
International Search Report and Written Opinion for Application No. PCT/US2011/065939 dated Apr. 20, 2012.
GENBANK Submission; NIH/NCBI, Accession No. AA106140. Marra et al., Feb. 4, 1997. 1 page.
GENBANK Submission; NIH/NCBI, Accession No. AL137002. Holt, Dec. 13, 2012. 29 pages.
GENBANK Submission; NIH/NCBI, Accession No. BX383579. Li et al., Dec. 23, 2010. 1 page.
GENBANK Submission; NIH/NCBI, Accession No. NM_001079668. Young et al., Jan. 18, 2014. 4 pages.
GENBANK Submission; NIH/NCBI, Accession No. NM_003317. Young et al., Jan. 18, 2014. 4 pages.
GENBANK Submission; NIH/NCBI, Accession No. NM_028475. Diez-Roux et al., Feb. 3, 2014. 6 pages.
[No Author Listed], Geneimprint. 2012. http://www.geneimprint.com/site/about-this-site [last accessed May 22, 2015]. 1 page.
[No Author Listed], Imprinted gene. Mosby's Dictionary of Medicine, Nursing and Health Professions. 8th ed. 2009;949.
Ahn et al., Retinoic acid accelerates downregulation of the Xist repressor, Oct4, and increases the likelihood of Xist activation when Tsix is deficient. BMC Develop Biol. 2010;10:90. 14 pages.
Anderson et al., Post-transcriptional regulons coordinate the initiation and resolution of inflammation. Nat Rev Immunol. Jan. 2010;10(1):24-35. doi: 10.1038/nri2685.
Astuti et al., Epigenetic alteration at the DLK1-GTL2 imprinted domain in human neoplasia: analysis of neuroblastoma, phaeochromocytoma and Wilms' tumour. Br J Cancer. Apr. 25, 2005;92(8):1574-80.

(56) References Cited

OTHER PUBLICATIONS

Beletskii et al., PNA interference mapping demonstrates functional domains in the noncoding RNA Xist. Proc Natl Acad Sci U S A. Jul. 31, 2001;98(16):9215-20.

Bernardi et al., Structure, dynamics and functions of promyelocytic leukaemia nuclear bodies. Nat Rev Mol Cell Biol. Dec. 2007;8(12):1006-16. Review.

Bernstein et al., Mouse polycomb proteins bind differentially to methylated histone H3 and RNA and are enriched in facultative heterochromatin. Mol Cell Biol. Apr. 2006;26(7):2560-9.

Bernstein et al., RNA meets chromatin. Genes Dev. Jul. 15, 2005;19(14):1635-55. Review.

Boyer et al., Polycomb complexes repress developmental regulators in murine embryonic stem cells. Nature. May 18, 2006;441(7091):349-53. Epub Apr. 19, 2006.

Brockdorff et al., The product of the mouse Xist gene is a 15 kb inactive X-specific transcript containing no conserved ORF and located in the nucleus. Cell. Oct. 30, 1992;71(3):515-26.

Brown et al., A gene from the region of the human X inactivation centre is expressed exclusively from the inactive X chromosome. Nature. Jan. 3, 1991;349:38-44.

Brown et al., The Human XIST Gene: Analysis of a 17 kb Inactive X-Specific RNA That Contains Conserved Repeats and is Highly Localized within the Nucleus. Cell. Oct. 30, 1992;71:527-42.

Carninci et al., The transcriptional landscape of the mammalian genome. Science. Sep. 2, 2005;309(5740):1559-63.

Chahrour et al., MeCP2, a key contributor to neurological disease, activates and represses transcription. Science. May 30, 2008;320(5880):1224-9.

Chen et al., Decoding the function of nuclear long non-coding RNAs. Curr Opin Cell Biol. Jun. 2010;22(3):357-64. doi: 10.1016/j.ceb.2010.03.003. Epub Mar. 29, 2010. Review.

Chow et al., Inducible XIST-dependent X-chromosome inactivation in human somatic cells is reversible. Proc Natl Acad Sci U S A. Jun. 12, 2007;104(24):10104-9. Epub May 30, 2007.

Clark et al., The Reality of Pervasive Transcription. PLOS Bio. Jul. 2011;9(7):e1000625. 6 pages.

Clemson et al., XIST RNA paints the inactive X chromosome at interphase: evidence for a novel RNA involved in nuclear/chromosome structure. J Cell Biol. Feb. 1996;132(3):259-75.

Cohen et al., X-chromosome inactivation and the search for chromosome-wide silencers. Curr Opin Genet Dev. 2002;12:219-24.

Coombes et al., Epigenetic properties and identification of an imprint mark in the Nesp-Gnasxl domain of the mouse Gnas imprinted locus. Mol Cell Biol. Aug. 2003;23(16):5475-88.

Corcia et al., The importance of the SMN genes in the genetics of sporadic ALS. Amyotroph Lateral Scler. Oct.-Dec. 2009;10(5-6):436-40. doi: 10.3109/17482960902759162.

Core et al., Nascent RNA sequencing reveals widespread pausing and divergent initiation at human promoters. Science. Dec. 19, 2008;322(5909):1845-8. doi: 10.1126/science.1162228. Epub Dec. 4, 2008.

Costa, Non-coding RNAs: new players in eukaryotic biology. Gene. Sep. 12, 2005;357(2):83-94. Review.

Daughters et al., RNA gain-of-function in spinocerebellar ataxia type 8. PLoS Genet. Aug. 2009;5(8):e1000600. doi: 10.1371/journal.pgen.1000600. Epub Aug. 14, 2009.

Davidson et al., Singles engage the RNA interference pathway. Cell. Aug. 31, 2012;150(5):873-5. doi: 10.1016/j.cell.2012.08.008.

Denisenko et al., Point mutations in the WD40 domain of Eed block its interaction with Ezh2. Mol Cell Biol. Oct. 1998;18(10):5634-42.

Di Certo et al., The artificial gene Jazz, a transcriptional regulator of utrophin, corrects the dystrophic pathology in mdx mice. Hum Mol Genet. Mar. 1, 2010;19(5):752-60. doi: 10.1093/hmg/ddp539. Epub Dec. 4, 2009.

Dinger et al., NRED: a database of long noncoding RNA expression. Nucleic Acids Res. Jan. 2009;37(Database issue):D122-6. doi: 10.1093/nar/gkn617. Epub Oct. 1, 2008.

Dominski et al., Identification and characterization by antisense oligonucleotides of exon and intron sequences required for splicing. Mol Cell Biol. Nov. 1994; 14(11): 7445-7454.

Dominski et al., Restoration of correct splicing in thalassemic pre-mRNA by antisense oligonucleotides. Proc Natl Acad Sci U S A. Sep. 15, 1993;90(18):8673-7.

Du et al., Progress toward therapy with antisense-mediated splicing modulation. Curr Opin Mol Ther. Apr. 2009;11(2):116-23.

Duthie et al., Xist RNA exhibits a banded localization on the inactive X chromosome and is excluded from autosomal material in cis. Hum Mol Genet. Feb. 1999;8(2):195-204.

Edwards et al., Mechanisms regulating imprinted genes in clusters. Curr Opin Cell Biol. Jun. 2007;19(3):281-9. Review.

Engström et al., Complex Loci in human and mouse genomes. PLoS Genet. Apr. 2006;2(4):e47. Epub Apr. 28, 2006.

Faghihi et al., Expression of a noncoding RNA is elevated in Alzheimer's disease and drives rapid feed-forward regulation of [beta]-secretase. Nat Med. Jul. 2008;14(7):723-30. doi:10.1038/nm1784. Epub Feb. 23, 2010. 19 pages.

Francis et al., Reconstitution of a functional core polycomb repressive complex. Mol Cell. Sep. 2001;8(3):545-56.

Frieden et al., Expanding the design horizon of antisense oligonucleotides with alpha-L-LNA. Nucleic Acids Res. Nov. 1, 2003;31(21):6365-72.

Froberg et al., Guided by RNAs: X-inactivation as a model for lncRNA function. J Mol Biol. Oct. 9, 2013;425(19):3698-706. doi: 10.1016/j.jmb.2013.06.031. Epub Jun. 28, 2013. Review. 15 pages.

Fu et al., Mir-144 selectively regulates embryonic alpha-hemoglobin synthesis during primitive erythropoiesis. Blood. Feb. 5, 2009;113(6):1340-9.

Golding et al., Depletion of Kcnq1ot1 non-coding RNA does not affect imprinting maintenance in stem cells. Development. 2011;138:3667-8. doi:10.1242/dev.057778.

Gontan et al., Long Noncoding RNAs and X Chromosome Inactivation. Prog Mol Subcell Biol. 2011;51:43-64. doi: 10.1007/978-3-642-16502-3_3.

Guo et al., High resolution genome wide binding event finding and motif discovery reveals transcription factor spatial binding constraints. PLoS Comput Biol. 2012;8(8):e1002638. doi: 10.1371/journal.pcbi.1002638. Epub Aug. 9, 2012.

Gupta et al., Long non-coding RNA HOTAIR reprograms chromatin state to promote cancer metastasis. Nature. Apr. 15, 2010;464(7291):1071-6. doi: 10.1038/nature08975. E-pub version.

Guttman et al., Chromatin signature reveals over a thousand highly conserved large non-coding RNAs in mammals. Nature. Mar. 12, 2009;458(7235):223-7. doi: 10.1038/nature07672. Epub Sep. 30, 2009. 13 pages.

Guttman et al., Modular regulatory principles of large non-coding RNAs. Nature. Feb. 15, 2012;482(7385):339-46. Review.

Hendrich et al., Evolutionary conservation of possible functional domains of the human and murine XIST genes. Human Molec Gen. 1993;2(6):663-72.

Horike et al., Targeted disruption of the human LIT1 locus defines a putative imprinting control element playing an essential role in Beckwith-Wiedemann syndrome. Hum Mol Genet. Sep. 1, 2000;9(14):2075-83.

Houseley et al., RNA-quality control by the exosome. Nat Rev Mol Cell Biol. Jul. 2006;7(7):529-39.

Hua et al., Antisense correction of SMN2 splicing in the CNS rescues necrosis in a type III SMA mouse model. Genes Dev. Aug. 1, 2010;24(15):1634-44. doi: 10.1101/gad.1941310. Epub Jul. 12, 2010.

Hua et al., Antisense Masking of an hnRNP A1/A2 Intronic Splicing Silencer Corrects SMN2 Splicing in Transgenic Mice. Am J Hum Genet. Apr. 11, 2008; 82(4):834-48. Published online Apr. 4, 2008. doi: 10.1016/j.ajhg.2008.01.014.

Hua et al., Enhancement of SMN2 Exon 7 Inclusion by Antisense Oligonucleotides Targeting the Exon. PLoS Biol. Apr. 2007;5(4):e73. Published online Mar. 13, 2007. doi: 10.1371/journal.pbio.0050073.

Hua et al., Peripheral SMN restoration is essential for long-term rescue of a severe spinal muscular atrophy mouse model. Nature. Oct. 5, 2011;478(7367):123-6. doi: 10.1038/nature10485.

(56) References Cited

OTHER PUBLICATIONS

Inesi et al., Studies of Ca2+ ATPase (SERCA) inhibition. J Bioenerg Biomembr. Dec. 2005;37(6):365-8. Review.

Inouye, Antisense RNA: its functions and applications in gene regulation—a review. Gene. Dec. 10, 1988;72(1-2):25-34.

Jeon et al., YY1 tethers Xist RNA to the inactive X nucleation center. Cell. Jul. 8, 2011;146(1):119-33. doi: 10.1016/j.cell.2011.06.026.

Jepsen et al., Locked nucleic acid: a potent nucleic acid analog in therapeutics and biotechnology. Oligonucleotides. 2004;14(2):130-46. Review.

Jia et al., Genome-wide computational identification and manual annotation of human long noncoding RNA genes. RNA. Aug. 2010;16(8):1478-87. doi: 10.1261/rna.1951310. Epub Jun. 29, 2010.

Johansson et al., Target-specific arrest of mRNA translation by antisense 2'-O-alkyloligoribonucleotides. Nucleic Acids Res. Nov. 11, 1994;22(22):4591-8.

Johnson, Long non-coding RNAs in Huntington's disease neurodegeneration. Neurobiol Dis. 2012;46:245-54.

Kanduri et al., The length of the transcript encoded from the Kcnq1ot1 antisense promoter determines the degree of silencing. EMBO J. 2006;25:2096-106.

Kanhere et al., Short RNAs are transcribed from repressed polycomb target genes and interact with polycomb repressive complex-2. Mol Cell. Jun. 11, 2010;38(5):675-88. doi: 10.1016/j.molcel.2010.03.019.

Kapranov et al., Genome-wide transcription and the implications for genomic organization. Nat Rev Genet. Jun. 2007;8(6):413-23.

Kapranov et al., RNA maps reveal new RNA classes and a possible function for pervasive transcription. Science. Jun. 8, 2007;316(5830):1484-8.

Khalil et al., Many human large intergenic noncoding RNAs associate with chromatin-modifying complexes and affect gene expression. Proc Natl Acad Sci U S A. Jul. 14, 2009;106(28):11667-72.

Kim et al., Identification of clustered YY1 binding sites in imprinting control regions. Genome Res. Jul. 2006;16(7):901-11. Epub Jun. 7, 2006.

Klein et al., Homeostatic regulation of MeCP2 expression by a CREB-induced microRNA. Nat Neurosci. Dec. 2007;10(12):1513-4.

Krützfeldt et al., Silencing of microRNAs in vivo with 'antagomirs'. Nature. Dec. 1, 2005;438(7068):685-9. Epub Oct. 30, 2005.

Ku et al., Genomewide analysis of PRC1 and PRC2 occupancy identifies two classes of bivalent domains. PLoS Genet. Oct. 2008;4(10):e1000242. doi: 10.1371/journal.pgen.1000242. Epub Oct. 31, 2008. 14 pages.

Lee et al., A 450 kb Transgene Displays Properties of the Mammalian X-Inactivation Center. Cell. Jul. 12, 1996;86:83-94.

Lee et al., Control of developmental regulators by Polycomb in human embryonic stem cells. Cell. Apr. 21, 2006;125(2):301-13.

Lee et al., Genetic analysis of the mouse X inactivation center defines an 80-kb multifunction domain. Proc Natl Acad Sci U S A. Mar. 30, 1999;96(7):3836-41.

Lee et al., Targeted Mutagenesis of Tsix Leads to Nonrandom X Inactivation. Cell. Oct. 1, 1999;99:47-57.

Lee et al., Tsix, a gene antisense to Xist at the X-inactivation centre. Nat Genet. Apr. 1999;21:400-4.

Lee, Disruption of Imprinted X Inactivation by Parent-of-Origin Effects at Tsix. Cell. Sep. 29, 2000;103:17-27.

Lee, Epigenetic regulation by long noncoding RNAs. Science. Dec. 14, 2012;338(6113):1435-9. Review.

Lee, Homozygous Tsix mutant mice reveal a sex-ratio distortion and revert to random X-inactivation. Nat Genet. Sep. 2002;32:195-200.

Lee, Lessons from X-chromosome inactivation: long ncRNA as guides and tethers to the epigenome. Genes Dev. Aug. 15, 2009;23(16):1831-42. doi: 10.1101/gad.1811209.

Lee, The X as a Model for RNA's Niche in Epigenomic Regulation. Cold Spring Harb Perspect Biol. 2010;2:A003749. 12 pages.

Li et al., Jarid2 and PRC2, partners in regulating gene expression. Genes Dev. Feb. 15, 2010;24(4):368-80. doi: 10.1101/gad.1886410. Epub Feb. 1, 2010.

Lim et al., Modulation of survival motor neuron pre-mRNA splicing by inhibition of alternative 3' splice site pairing. J Biol Chem. Nov. 30, 2001;276(48):45476-83. Epub Oct. 2, 2001.

Lima et al., Single-stranded siRNAs activate RNAi in animals. Cell. Aug. 31, 2012;150(5):883-94. doi: 10.1016/j.cell.2012.08.014.

Lin et al., An in-depth map of polyadenylation sites in cancer. Nucleic Acids Res. Sep. 1, 2012;40(17):8460-71. Epub Jun. 29, 2012.

Lin et al., Asymmetric regulation of imprinting on the maternal and paternal chromosomes at the Dlk1-Gtl2 imprinted cluster on mouse chromosome 12. Nat Genet. Sep. 2003;35(1):97-102. Epub Aug. 24, 2003.

Lipovich et al., MacroRNA underdogs in a microRNA world: evolutionary, regulatory, and biomedical significance of mammalian long non-protein-coding RNA. Biochim Biophys Acta. Sep. 2010;1799(9):597-615. Review.

Margueron et al., The Polycomb complex PRC2 and its mark in life. Nature. Jan. 20, 2011;469(7330):343-9. Review.

Mercer et al., Long non-coding RNAs: insights into functions. Nat Rev Genet. Mar. 2009;10(3):155-9. Review.

Mercer et al., Structure and function of long noncoding RNAs in epigenetic regulation. Mar. 5, 2013;20:300-7.

Merienne et al., SCA8 CAG/CTG expansions, a tale of two TOXICities: a unique or common case? PLoS Genet. Aug. 2009;5(8):e1000593. doi: 10.1371/journal.pgen.1000593. Epub Aug. 14, 2009.

Miller et al., A TALE nuclease architecture for efficient genome editing. Nat Biotechnol. Feb. 2011;29(2):143-8. doi: 10.1038/nbt.1755. Epub Dec. 22, 2010.

Miremadi et al., Cancer genetics of epigenetic genes. Hum Mol Genet. Apr. 15, 2007;16 Spec No. 1:R28-49. Review.

Miura et al., Utrophin upregulation for treating Duchenne or Becker muscular dystrophy: how close are we? Trends Mol Med. Mar. 2006;12(3):122-9. Epub Jan. 27, 2006.

Miyajima et al., Identification of a cis-acting element for the regulation of SMN exon 7 splicing. J Biol Chem. Jun. 28, 2002;277(26):23271-7. Epub Apr. 15, 2002.

Modarresi et al., Inhibition of natural antisense transcripts in vivo results in gene-specific transcriptional upregulation. Nat Biotechnol. Mar. 25, 2012;30(5):453-9. doi: 10.1038/nbt.2158. 21 pages.

Montgomery et al., The murine polycomb group protein Eed is required for global histone H3 lysine-27 methylation. Curr Biol. May 24, 2005;15(10):942-7.

Morris et al., Small interfering RNA-induced transcriptional gene silencing in human cells. Science. Aug. 27, 2004;305(5688):1289-92. Epub Aug. 5, 2004.

Morris, RNA-mediated transcriptional gene silencing in human cells. Curr Top Microbiol Immunol. 2008;320:211-24. Review.

Munroe, Antisense RNA inhibits splicing of pre-mRNA in vitro. EMBO J. Aug. 1988; 7(8): 2523-32.

Nagano et al., The Air noncoding RNA epigenetically silences transcription by targeting G9a to chromatin. Science. Dec. 12, 2008;322(5908):1717-20.

Nie et al., Long non-coding RNAs: versatile master regulators of gene expression and crucial players in cancer. Am J Transl Res. 2012;4(2):127-50. Epub Apr. 8, 2012.

Numata et al., Comparative analysis of cis-encoded antisense RNAs in eukaryotes. Gene. May 1, 2007;392(1-2):134-41.

Numata et al., Identification of novel endogenous antisense transcripts by DNA microarray analysis targeting complementary strand of annotated genes. BMC Genomics. Aug. 22, 2009;10:392. doi: 10.1186/1471-2164-10-392.

Okada et al., Comparative expression analysis uncovers novel features of endogenous antisense transcription. Hum Mol Genet. Jun. 1, 2008;17(11):1631-40. doi: 10.1093/hmg/ddn051. Epub Feb. 18, 2008.

Ørom et al., LNA-modified oligonucleotides mediate specific inhibition of microRNA function. Gene. May 10, 2006;372:137-41. Epub Feb. 24, 2006.

(56) References Cited

OTHER PUBLICATIONS

Ozsolak et al., Comprehensive polyadenylation site maps in yeast and human reveal pervasive alternative polyadenylation. Cell. Dec. 10, 2010;143(6):1018-29. doi: 10.1016/j.cell.2010.11.020.
Pandey et al., Kcnq1ot1 antisense noncoding RNA mediates lineage-specific transcriptional silencing through chromatin-level regulation. Mol Cell. Oct. 24, 2008;32(2):232-46. doi: 10.1016/j.molcel.2008.08.022.
Paro et al., Extending the frontiers of epigenetic regulation. Curr Opin Genet Dev. Apr. 2010;20(2):107-9. doi: 10.1016/j.gde.2010.03.011.
Pasini et al., Suz12 is essential for mouse development and for EZH2 histone methyltransferase activity. EMBO J. Oct. 13, 2004;23(20):4061-71. Epub Sep. 23, 2004.
Peng et al., Jarid2/Jumonji coordinates control of PRC2 enzymatic activity and target gene occupancy in pluripotent cells. Cell. Dec. 24, 2009;139(7):1290-302. doi: 10.1016/j.cell.2009.12.002. Epub Jul. 29, 2010. 24 pages.
Penny et al., Requirement for Xist in X chromosome inactivation. Nature. Jan. 11, 1996;379(6561):131-7.
Pereira et al., Ezh2, the histone methyltransferase of PRC2, regulates the balance between self-renewal and differentiation in the cerebral cortex. Proc Natl Acad Sci U S A. Sep. 7, 2010;107(36):15957-62. doi: 10.1073/pnas.1002530107. Epub Aug. 23, 2010.
Petersen et al., LNA: a versatile tool for therapeutics and genomics. TRENDS Biotech. Feb. 2003;21(2):74-81. Review.
Pietersen et al., Stem cell regulation by polycomb repressors: postponing commitment. Curr Opin Cell Biol. Apr. 2008;20(2):201-7. doi: 10.1016/j.ceb.2008.01.004. Epub Mar. 4, 2008. Review.
Plath et al., Role of Histone H3 Lysine 27 Methylation in X Inactivation. Science. Apr. 4, 2003;300:131-5. doi: 10.1126/science.1084274.
Ponting et al., Evolution and functions of long noncoding RNAs. Cell. Feb. 20, 2009;136(4):629-41. doi: 10.1016/j.cell.2009.02.006. Review.
Qi et al., Repurposing CRISPR as an RNA-guided platform for sequence-specific control of gene expression. Cell. Feb. 28, 2013;152(5):1173-83. doi: 10.1016/j.cell.2013.02.022.
Rajasekhar et al., Concise review: roles of polycomb group proteins in development and disease: a stem cell perspective. Stem Cells. Oct. 2007;25(10):2498-510. Epub Jun. 28, 2007. Review.
Redrup et al., The long noncoding RNA Kcnq1ot1 organises a lineage-specific nuclear domain for epigenetic gene silencing. Development. Feb. 2009;136(4):525-30. doi: 10.1242/dev.031328. Epub Jan. 14, 2009. 14 pages.
Reyon et al., Flash assembly of TALENs for high-throughput genome editing. Nat Biotechnol. May 2012;30(5):460-5. doi: 10.1038/nbt.2170.
Ringrose et al., Epigenetic regulation of cellular memory by the Polycomb and Trithorax group proteins. Annu Rev Genet. 2004;38:413-43. Review.
Rinn et al., Functional demarcation of active and silent chromatin domains in human HOX loci by noncoding RNAs. Cell. Jun. 29, 2007;129(7):1311-23.
Rinn et al., Genome Regulation by Long Noncoding RNAs. Annu Rev Biochem. 2012;81:145-66.
Røsok et al., Systematic identification of sense-antisense transcripts in mammalian cells. Nat Biotechnol. Jan. 2004;22(1):104-8. Epub Dec. 14, 2003.
Sankaran et al., MicroRNA-15a and -16-1 act via MYB to elevate fetal hemoglobin expression in human trisomy 13. Proc Natl Acad Sci U S A. Jan. 25, 2011;108(4):1519-24.
Sankaran, Targeted therapeutic strategies for fetal hemoglobin induction. Hematol Am Soc Hematol Educ Program. 2011;2011:459-65.
Sarma et al., Locked nucleic acids (LNAs) reveal sequence requirements and kinetics of Xist RNA localization to the X chromosome. Proc Natl Acad Sci U S A. Dec. 21, 2010;107(51):22196-201. doi: 10.1073/pnas.1009785107. Epub Dec. 6, 2010.
Saxena et al., Long non-coding RNA modifies chromatin. Bioessays. 2011;33:830-9. Review.
Schoeftner et al., Recruitment of PRC1 function at the initiation of X inactivation independent of PRC2 and silencing. EMBO J. Jul. 12, 2006;25(13):3110-22. Epub Jun. 8, 2006.
Schuettengruber et al., Genome regulation by polycomb and trithorax proteins. Cell. Feb. 23, 2007;128(4):735-45.
Schultz et al., Enhancers compete with a long non-coding RNA for regulation of the Kcnq1 domain. Nucl Acids Res. 2015;43(2):745-59.
Schwartz et al., Genome-wide analysis of Polycomb targets in *Drosophila melanogaster*. Nat Genet. Jun. 2006;38(6):700-5.
Schwartz et al., Polycomb complexes and epigenetic states. Curr Opin Cell Biol. 2008;20:266-73. doi: 10.1016/j.ceb.2008.03.002.
Seong et al., Huntingtin facilitates polycomb repressive complex 2. Hum Mol Genet. Feb. 15, 2010;19(4):573-83. doi: 10.1093/hmg/ddp524. Epub Nov. 23, 2009.
Shaver et al., Origin of the polycomb repressive complex 2 and gene silencing by an E(z) homolog in the unicellular alga Chlamydomonas. Epigenetics. May 16, 2010;5(4):301-12. Epub May 24, 2010.
Shen et al,. EZH1 mediates methylation on histone H3 lysine 27 and complements EZH2 in maintaining stem cell identity and executing pluripotency. Mol Cell. Nov. 21, 2008;32(4):491-502. doi: 10.1016/j.molcel.2008.10.016.
Shen et al., Jumonji modulates polycomb activity and self-renewal versus differentiation of stem cells. Cell. Dec. 24, 2009;139(7):1303-14. doi: 10.1016/j.cell.2009.12.003. Epub Jun. 24, 2010. 26 pages.
Shiraki et al., Cap analysis gene expression for high-throughput analysis of transcriptional starting point and identification of promoter usage. Proc Natl Acad Sci U S A. Dec. 23, 2003;100(26):15776-81. Epub Dec. 8, 2003.
Shore et al., Pregnancy-induced noncoding RNA (PINC) associates with polycomb repressive complex 2 and regulates mammary epithelial differentiation. PLoS Genet. 2012;8(7):e1002840. doi: 10.1371/journal.pgen.1002840. Epub Jul. 26, 2012.
Simon et al., High-resolution Xist binding maps reveal two-step spreading during X-chromosome inactivation. Nature. Dec. 19, 2013;504(7480):465-9. doi: 10.1038/nature12719. Epub Oct. 27, 2013.
Simon et al., Roles of the EZH2 histone methyltransferase in cancer epigenetics. Mutat Res. Dec. 1, 2008;647(1-2):21-9. Review.
Sing et al., A vertebrate Polycomb response element governs segmentation of the posterior hindbrain. Cell. Sep. 4, 2009;138(5):885-97. doi: 10.1016/j.cell.2009.08.020.
Singh et al., Splicing of a Critical Exon of Human Survival Motor Neuron is Regulated by a Unique Silencer Element Located in the Last Intron. Mol Cell Biol. Feb. 2006;26(4):1333-46. doi: 10.1128/MCB.26.4.1333-1346.2006.
Sparmann et al., Polycomb silencers control cell fate, development and cancer. Nat Rev Cancer. Nov. 2006;6(11):846-56. Review.
Taft et al., Non-coding RNAs: regulators of disease. J Pathol. Jan. 2010;220(2):126-39. doi: 10.1002/path.2638. Review.
Taft et al., Tiny RNAs associated with transcription start sites in animals. Nat Genet. May 2009;41(5):572-8. doi: 10.1038/ng.312. Epub Apr. 19, 2009. Erratum in: Nat Genet. Jul. 2009;41(7):859.
Takagi et al., Role of Sp1 in transcription of human ATP2A2 gene in keratinocytes. J Invest Dermatol. Jan. 2008;128(1):96-103. Epub Jun. 28, 2007.
Takahashi et al., Deletion of Gtl2, imprinted non-coding RNA, with its differentially methylated region induces lethal parent-origin-dependent defects in mice. Hum Mol Genet. May 15, 2009;18(10):1879-88. doi: 10.1093/hmg/ddp108. Epub Mar. 4, 2009.
Tano et al., MALAT-1 enhances cell motility of lung adenocarcinoma cells by influencing the expression of motility-related genes. FEBS Lett. Nov. 19, 2010;584(22):4575-80. doi: 10.1016/j.febslet.2010.10.008. Epub Oct. 13, 2010.
Thorvaldsen et al., A YY1 bridge for X inactivation. Cell. Jul. 8, 2011;146(1):11-3. doi: 10.1016/j.cell.2011.06.029.
Thorvaldsen et al., SnapShot: imprinted gene clusters. Cell. Sep. 7, 2007;130(5):958.

(56) References Cited

OTHER PUBLICATIONS

Tian et al., The long noncoding RNA, Jpx, is a molecular switch for X chromosome inactivation. Cell. Oct. 29, 2010;143(3):390-403. doi: 10.1016/j.cell.2010.09.049. 21 pages.

Tsai et al., Higher order chromatin structure at the X-inactivation center via looping DNA. Dev Biol. Jul. 15, 2008;319(2):416-25. doi: 10.1016/j.ydbio.2008.04.010. Epub Apr. 18, 2008. 22 pages.

Tsai et al., Long noncoding RNA as modular scaffold of histone modification complexes. Science. Aug. 6, 2010;329(5992):689-93. doi: 10.1126/science.1192002. Epub Nov. 2, 2010. 9 pages.

Tsuiji et al., Spliceosome integrity is defective in the motor neuron diseases ALS and SMA. EMBO Mol Med. Feb. 2013;5(2):221-34. doi: 10.1002/emmm.201202303. Epub Jan. 25, 2013.

Valen et al., Genome-wide detection and analysis of hippocampus core promoters using DeepCAGE. Genome Res. Feb. 2009;19(2):255-65. doi: 10.1101/gr.084541.108. Epub Dec. 11, 2008.

Vickers et al., Fully modified 2' MOE oligonucleotides redirect polyadenylation. Nucleic Acids Res. Mar. 15, 2001;29(6):1293-9.

Wahlestedt, Natural antisense and noncoding RNA transcripts as potential drug targets. Drug Discov Today. Jun. 2006;11(11-12):503-8.

Wahlestedt, Targeting long non-coding RNA to therapeutically upregulate gene expression. Nature Rev Drug Disc. Jun. 2013;12:433-46. Review.

Wan et al., Regulation of imprinting in clusters: noncoding RNAs versus insulators. Adv Genet. 2008;61:207-23. Review.

Wang et al., Long non-coding RNA UCA1a(CUDR) promotes proliferation and tumorigenesis of bladder cancer. Int J Oncol. Jul. 2012;41(1):276-84.

Wang et al., Molecular mechanisms of long noncoding RNAs. Cell Press. Sep. 16, 2011;43(6):904-14.

Williamson et al., Identification of an imprinting control region affecting the expression of all transcripts in the Gnas cluster. Nat Genet. Mar. 2006;38(3):350-5.

Wilusz et al., A triple helix stabilizes the 3' ends of long noncoding RNAs that lack poly(A) tails. Genes Dev. Nov. 1, 2012;26(21):2392-407. doi: 10.1101/gad.204438.112. Epub Oct. 16, 2012.

Woo et al., A Region of theHuman HOXDCluster that Confers Polycomb-Group Responsiveness. Cell. Jan. 8, 2010;140:99-110.

Wutz et al., A Shift from Reversible to Irreversible X Inactivation is Triggered during ES Cell Differentiation. Molec Cell. Apr. 2000;5:695-705.

Xiong et al., Polycomb antagonizes p300/CREB-binding protein associated factor to silence FOXP3 in a Kruppel-like factor-dependent manner. J Biol Chem. Oct. 5, 2012;287(41):34372-85. doi: 10.1074/jbc.M111.325332. Epub Aug. 15, 2012.

Yang et al., Long noncoding RNAs: fresh perspectives into the RNA world. Trends Biochem Sci. Jan. 2014;39(1):35-43. doi: 10.1016/j.tibs.2013.10.002. Epub Nov. 27, 2013. Review.

Yap et al., Molecular interplay of the noncoding RNA ANRIL and methylated histone H3 lysine 27 by polycomb CBX7 in transcriptional silencing of INK4a. Mol Cell. Jun. 11, 2010;38(5):662-74. doi: 10.1016/j.molcel.2010.03.021. Epub Jun. 11, 2011. 23 pages.

Yatsuki et al., Sequence-based structural features between Kvlqt1 and Tapa1 on mouse chromosome 7F4/F5 corresponding to the Beckwith-Wiedemann syndrome region on human 11p15.5: longstretches of unusually well conserved intronic sequences of kvlqt1 between mouse and human. DNA Res. Jun. 30, 2000;7(3):195-206.

Yu et al., Single-stranded RNAs use RNAi to potently and alleleselectively inhibit mutant huntingtin expression. Cell. Aug. 31, 2012;150(5):895-908. doi: 10.1016/j.cell.2012.08.002.

Zhang et al., Long noncoding RNA-mediated intrachromosomal interactions promote imprinting at the Kcnq1 locus. J Cell Biol. 2014;204(1):61-75.

Zhang et al., NATsDB: Natural Antisense Transcripts DataBase. Nucleic Acids Res. Jan. 2007;35(Database issue):D156-61. Epub Nov. 1, 2006.

Zhang et al., Perinucleolar Targeting of the Inactive X during S Phase: Evidence for a Role in the Maintenance of Silencing. Cell. May 18, 2007;129:693-706.

Zhao et al., Genome-wide identification of polycomb-associated RNAs by RIP-seq. Mol Cell. Dec. 22, 2010;40(6):939-53.

Zhao et al., Polycomb proteins targeted by a short repeat RNA to the mouse X-chromosome. Science. 2008; 322(5902):750-756. doi:10.1126/science.1163045. E-pub version.

Submission. EBI Accession No. EMBL:GC092872. Palma et al. Aug. 31, 2008.

GENBANK Submission; NCBI, Accession No. NG_008691.1 Mar. 2011. 11 pages.

GENBANK Submission; NCBI, Accession No. NM_022876.2. Apr. 2010. 5 pages.

GENBANK Submission; NIH/NCBI, Accession No. ABZ86223. Nyce et al. Oct. 17, 2003.

GENBANK Submission; NCBI, Accession No. AM773775. Radha et al., Jul. 13, 2007.

GENBANK Submission; NCBI, Accession No. AM911724.1; Talwar et al. Nov. 26, 2007.

[No Author Listed] Catalogue of Parent of Origin Effects, Imprinted Genes and Related Effects, Parental Origins of de novo Mutations, downloaded at http://igc.otago.ac.nz/home.html on May 22, 2015, 2 pgs.

[No Author Listed] Locked Nucleic Acid. Exiqon. 2009. Retrieved from http://www.exiqon.com/ls/documents/scientific/lna_folder.pdf on Jun. 6, 2016.

[No Author Listed] UCSC Genome Browser on Human Feb. 2009 (GRCh37/hg19) Assembly. Retrieved from http://genome.ucsc.edu/cgi-bin/hgTracks?db=hgl 9&position=chr5%3A 702 11956-7027 1 955&hgsid=452570083 _sxavccF 1dzrwhzM3tcNOyMcxbye 7 on Nov. 9, 2015.

[No Author Listed], New England BioLabs 1998/99 Catalog. 121, 284.

Blauw et al., SMN1 gene duplications are associated with sporadic ALS. Neurology. Mar. 13, 2012;78(11):776-80. doi: 10.1212/WNL.0b013e318249f697. Epub Feb. 8, 2012.

Buck et al., Design strategies and performance of custom DNA sequencing primers. Biotechniques. Sep. 1999;27(3):528-36.

Burghes et al., Antisense oligonucleotides and spinal muscular atrophy: skipping along. Genes Dev. Aug. 1, 2010;24(15):1574-9. doi:10.1101/gad.1961710.

Burglen et al., Structure and organization of the human survival motor neurone (SMN) gene. Genomics. Mar. 15, 1996;32(3):479-82.

Corcia et al., Homozygous SMN2 deletion is a protective factor in the Swedish ALS population. Eur J Hum Genet. May 2012;20(5):588-91. doi: 10.1038/ejhg.2011.255. Epub Jan. 25, 2012.

Crea et al., Pharmacologic disruption of Polycomb Repressive Complex 2 inhibits tumorigenicity and tumor progression in prostate cancer. Mol Cancer. Apr. 18, 2011;10:40. doi: 10.1186/1476-4598-10-40.

Davidovich et al., Toward a consensus on the binding specificity and promiscuity of PRC2 for RNA. Mol Cell. Feb. 5, 2015;57(3):552-8. doi: 10.1016/j.molcel.2014.12.017. Epub Jan. 15, 2015.

Dheda et al., Validation of housekeeping genes for normalizing RNA expression in real-time PCR. Biotechniques. Jul. 2004;37(1):112-4, 116, 118-9.

Dias et al., Antisense oligonucleotides: basic concepts and mechanisms. Mol Cancer Ther. Mar. 2002;1(5):347-55.

Eddy, Non-coding RNA genes and the modern RNA world. Nat Rev Genet. Dec. 2001;2(12):919-29.

Feldkötter et al., Quantitative analyses of SMN1 and SMN2 based on real-time lightCycler PCR: fast and highly reliable carrier testing and prediction of severity of spinal muscular atrophy. Am J Hum Genet. Feb. 2002;70(2):358-68. Epub Dec. 21, 2001.

Fish et al., Hypoxia-inducible expression of a natural cis-antisense transcript inhibits endothelial nitric-oxide synthase. J Biol Chem. May 25, 2007;282(21):15652-66. Epub Apr. 2, 2007.

Gerbino et al., Mislocalised FUS mutants stall spliceosomal snRNPs in the cytoplasm. Neurobiol Dis. Jul. 2013;55:120-8. doi:10.1016/j.nbd.2013.03.003. Epub Mar. 21, 2013.

(56) References Cited

OTHER PUBLICATIONS

Groen et al., ALS-associated mutations in FUS disrupt the axonal distribution and function of SMN. Hum Mol Genet. Sep. 15, 2013;22(18):3690-704. doi: 10.1093/hmg/ddt222. Epub May 15, 2013.
Hernandez et al., Degradation of nuclease-stabilized RNA oligonucleotides in Mycoplasma-contaminated cell culture media. Nucleic Acid Ther. Feb. 2012;22(1):58-68. doi: 10.1089/nat.2011.0316. Epub Jan. 9, 2012.
Huang, Shoujun et al., Non-encoding RNA and development of animals, Science China Life Science, Dec. 31, 2009; pp. 21-30.
Inoue et al., Synthesis and hybridization studies on two complementary nona(2'-O-methyl)ribonucleotides. Nucleic Acids Res. Aug. 11, 1987;15(15):6131-48.
Jackson et al., Expression profiling reveals off-target gene regulation by RNAi. Nat Biotechnol. Jun. 2003;21(6):635-7. Epub May 18, 2003.
Kariya et al., Mutant superoxide dismutase 1 (SOD1), a cause of amyotrophic lateral sclerosis, disrupts the recruitment of SMN, the spinal muscular atrophy protein to nuclear Cajal bodies. Hum Mol Genet. Aug. 1, 2012;21(15):3421-34. doi: 10.1093/hmg/dds174. Epub May 11, 2012.
Keil et al., A short antisense oligonucleotide ameliorates symptoms of severe mouse models of spinal muscular atrophy. Mol Ther Nucleic Acids. Jul. 8, 2014;3:e174. doi: 10.1038/mtna.2014.23.
Lapointe et al., Gene expression profiling identifies clinically relevant subtypes of prostate cancer. Proc Natl Acad Sci U S A. Jan. 20, 2004;101(3):811-6. Epub Jan. 7, 2004.
Latorra et al., Design considerations and effects of LNA in PCR primers. Mol Cell Probes. Oct. 2003;17(5):253-9.
Lee et al., Homozygous SMN2 Deletion is a Major Risk Factor among Twenty-Five Korean Sporadic Amyotrophic Lateral Sclerosis Patients . Yonsei Med J. Jan. 2012;53(1):53-57.
Lennox et al., Improved Performance of Anti-miRNA Oligonucleotides Using a Novel Non-Nucleotide Modifier. Mol Ther Nucleic Acids. Aug. 27, 2013;2:e117. doi: 10.1038/mtna.2013.46.
Nishida et al., Synthesis, RNA selective hybridization and high nuclease resistance of an oligonucleotide containing novel bridged nucleic acid with cyclic urea structure. Chem Commun (Camb). Aug. 7, 2010;46(29):5283-5. doi: 10.1039/c0cc00154f. Epub Jun. 22, 2010.
Niwano et al., Lentiviral vector-mediated SERCA2 gene transfer protects against heart failure and left ventricular remodeling after myocardial infarction in rats. Mol Ther. Jun. 2008;16(6):1026-32. doi: 10.1038/mt.2008.61. Epub Mar. 25, 2008.
Rozen et al., Primer3 on the WWW for general users and for biologist programmers. Methods Mol Biol. 2000;132:365-86.
Schadt et al., An integrative genomics approach to infer causal associations between gene expression and disease. Nat Genet. Jul. 2005;37(7):710-7. Epub Jun. 19, 2005.
Singh et al., A short antisense oligonucleotide masking a unique intronic motif prevents skipping of a critical exon in spinal muscular atrophy. RNA Biol. Jul.-Aug. 2009;6(3):341-50. Epub Jul. 14, 2009.
Skordis et al., antisense oligonucleotides provide a trans-acting splicing enhancer that stimulates SMN2 gene expression in patient fibroblasts. Proc Natl Acad Sci U S A. Apr. 1, 2003;100(7):4114-9. Epub Mar. 17, 2003.
Taylor et al., Antisense oligonucleotides: a systematic high-throughput approach to target validation and gene function determination. Drug Discov Today. Dec. 1999;4(12):562-567.
Turner et al., Survival motor neuron deficiency enhances progression in an amyotrophic lateral sclerosis mouse model. Neurobiol Dis. Jun. 2009;34(3):511-7. doi: 10.1016/j.nbd.2009.03.005. Epub Mar. 28, 2009.
Varela et al., Natural Antisense Makes Sense for Gene-specific Activation in Brain. Mol Ther Nucleic Acids. May 15, 2012;1:e24. doi: 10.1038/mtna.2012.17.
Veldink et al., SMN genotypes producing less SMN protein increase susceptibility to and severity of sporadic ALS. Neurology. Sep. 27, 2005;65(6):820-5. Epub Aug. 10, 2005.

Venter et al., The sequence of the human genome. Science. Feb. 16, 2001;291(5507):1304-51. Erratum in: Science Jun. 5, 2001;292(5523):1838.
Whitehead et al., Variation in tissue-specific gene expression among natural populations. Genome Biol. 2005;6(2):R13. Epub Jan. 26, 2005.
Wilusz et al., Long noncoding RNAs: functional surprises from the RNA world. Genes Dev. Jul. 1, 2009;23(13):1494-504. doi:10.1101/gad.1800909.
Yamazaki et al., FUS-SMN protein interactions link the motor neuron diseases ALS and SMA. Cell Rep. Oct. 25, 2012;2(4):799-806. doi:10.1016/j.celrep.2012.08.025. Epub Sep. 27, 2012.
Yang et al., High fidelity PCR with an off/on switch mediated by proofreading polymerases combining with phosphorothioate-modified primer. Biochem Biophys Res Commun. Mar. 4, 2005;328(1):265-72. Erratum in: Biochem Biophys Res Commun. Jun. 3, 2005;331(2):682. Zhang, Jia [removed]; Li, Kai [removed].
[No Author Listed] ncRNA. 2011;29(11):1716-1721.
Aartsma-Rus et al., Antisense-induced multiexon skipping for Duchenne muscular dystrophy makes more sense. Am J Hum Genet. Jan. 2004;74(1):83-92.
Bauer et al., The quest for mammalian Polycomb response elements: are we there yet? Chromosoma. Jun. 2016;125(3):471-96. doi:10.1007/s00412-015-0539-4.
Behlke et al., Designing antisense oligonucleotides. Integrated DNA Technologies. 2005. 1-17.
Beltran et al., The interaction of PRC2 with RNA or chromatin is mutually antagonistic. Genome Res. Jul. 2016;26(7):896-907. doi:10.1101/gr.197632.115. Epub May 9, 2016.
Broderick et al., MicroRNA therapeutics. Gene Ther. Dec. 2011;18(12):1104-10. doi: 10.1038/gt.2011.50. Epub Apr. 28, 2011.
Cantàfora et al., Evaluation of RNA messengers involved in lipid trafficking of human intestinal cells by reverse-transcription polymerase chain reaction with competimer technology and microchip electrophoresis. Electrophoresis. Nov. 2003;24(21):3748-54.
Crooke, Antisense drug technology. Principles, strategies, and applications. 2nd edition. CRC Press. 2007. 120-123.
Cuddapah et al., A novel human polycomb binding site acts as a functional polycomb response element in Drosophila. PLoS One. 2012;7(5):e36365. doi: 10.1371/journal.pone.0036365. Epub May 3, 2012.
Cushman et al., Synthesis of the covalent hydrate of the incorrectly assumed structure of aurintricarboxylic acid (ATA). Tetrahedron. 1990;46(5):1491-1498.
Davidovich et al., The recruitment of chromatin modifiers by long noncoding RNAs: lessons from PRC2. RNA. Dec. 2015;21(12):2007-22. doi:10.1261/rna.053918.115.
Gajera et al., Molecular and biochemical characterization of Trichoderma isolates inhibiting a phytopathogenic fungi Aspergillus niger Van Tieghem. Phys Mol Plant Path. 2010;74:274-282.
Ganguli et al., Antagomirbase—a putative antagomir database. Bioinformation. 2011;7(1):41-3.
GENBANK Submission; Accession No. AM750048. Gupta et al. Jul. 12, 2007.
Halley et al., Natural antisense transcripts as therapeutic targets. Drug Discov Today Ther Strateg. 2013 Fall;10(3):e119-e125.
He et al., Polycomb repressive complex 2 regulates normal development of the mouse heart. Circ Res. Feb. 3, 2012;110(3):406-15. doi: 10.1161/CIRCRESAHA.111.252205. Epub Dec. 8, 2011.
Kao et al., Tumor necrosis factor-alpha decreases sarcoplasmic reticulum Ca2+-ATPase expressions via the promoter methylation in cardiomyocytes. Crit Care Med. Jan. 2010;38(1):217-22. doi: 10.1097/CCM.0b013e3181b4a854.
Kierzek et al., The influence of locked nucleic acid residues on the thermodynamic properties of 2'-O-methyl RNA/RNA heteroduplexes. Nucleic Acids Res. Sep. 9, 2005;33(16):5082-93. Print 2005.
Kiss, Small nucleolar RNA-guided post-transcriptional modification of cellular RNAs. EMBO J. Jul. 16, 2001;20(14):3617-22.
Kutyavin et al., Reduced aggregation and improved specificity of G-rich oligodeoxyribonucleotides containing pyrazolo[3,4-d]pyrimidine guanine bases. Nucleic Acids Res. Nov. 15, 2002;30(22):4952-9.

(56) References Cited

OTHER PUBLICATIONS

Li et al., CTCF regulates allelic expression of Igf2 by orchestrating a promoter-polycomb repressive complex 2 intrachromosomal loop. Mol Cell Biol. Oct. 2008;28(20):6473-82. doi: 10.1128/MCB.00204-08. Epub Jul. 28, 2008.
Mencia et al., Mutations in the seed region of human miR-96 are responsible for nonsyndromic progressive hearing loss. Nat Genet. May 2009;41(5):609-13. doi: 10.1038/ng.355. Epub Apr. 12, 2009.
Mendenhall et al., GC-rich sequence elements recruit PRC2 in mammalian ES cells. PLoS Genet. Dec. 9, 2010;6(12):e1001244. doi: 10.1371/journal.pgen.1001244.
Mirguet et al., From ApoA1 upregulation to BET family bromodomain inhibition:discovery of I-BET151. Bioorg Med Chem Lett. Apr. 15, 2012;22(8):2963-7. doi:10.1016/j.bmcl.2012.01.125. Epub Feb. 8, 2012.
Morse et al., Depleting regulatory T cells with arginine-rich, cell-penetrating, peptide-conjugated morpholino oligomer targeting FOXP3 inhibits regulatory T-cell function. Cancer Gene Ther. Jan. 2012;19(1):30-7. doi: 10.1038/egt.2011.63.
Nakao, Gene Cluster control through epigenetic mechanisms and cytopathology. Uehara memorial life science foundation research report collection. 23;2009:1-4.
Prensner et al., Transcriptome sequencing across a prostate cancer cohort identifies PCAT-1, an unannotated lincRNA implicated in disease progression. Nat Biotechnol. Jul. 31, 2011;29(8):742-9. doi: 10.1038/nbt.1914.
Rader, Molecular regulation of HDL metabolism and function: implications for novel therapies. J Clin Invest. Dec. 2006;116(12):3090-100.
Schlesinger et al., Polycomb-mediated methylation on Lys27 of histone H3 pre-marks genes for de novo methylation in cancer. Nat Genet. Feb. 2007;39(2):232-6. Epub Dec. 31, 2006.
Schwartz et al., Polycomb silencing mechanisms and the management of genomic programmes. Nat Rev Genet. Jan. 2007;8(1):9-22.
Sciabola et al., Improved nucleic acid descriptors for siRNA efficacy prediction. Nucleic Acids Res. Feb. 1, 2013;41(3):1383-94. doi: 10.1093/nar/gks1191. Epub Dec. 14, 2012.
Sun et al., Evidence for a preferential targeting of 3'-UTRs by cis-encoded natural antisense transcripts. Nucleic Acids Res. Oct. 4, 2005;33(17):5533-43. Print 2005.
Sun et al., SNPs in human miRNA genes affect biogenesis and function. RNA. Sep. 2009;15(9):1640-51. doi: 10.1261/rna.1560209. Epub Jul. 17, 2009.
Tae et al., Bromodomain protein 7 interacts with PRMT5 and PRC2, and is involved in transcriptional repression of their target genes. Nucleic Acids Res. Jul. 2011;39(13):5424-38. doi: 10.1093/nar/gkr170.
Van Peer et al., miRBase Tracker: keeping track of microRNA annotation changes. Database (Oxford). Aug. 25, 2014;2014. pii:bau080. doi: 10.1093/database/bau080. Print 2014.
Williams et al., Oligonucleotide-mediated survival of motor neuron protein expression in CNS improves phenotype in a mouse model of spinal muscular atrophy. J Neurosci. Jun. 17, 2009;29(24):7633-8. doi: 10.1523/JNEUROSCI.0950-09.2009.
Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.
Wu et al., Binding interactions between long noncoding RNA HOTAIR and PRC2 proteins. Biochemistry. Dec. 31, 2013;52(52):9519-27. doi: 10.1021/bi401085h.
Yakali et al., Supramolecular chirality-sensing DNA-mimicry of a norbornane derivative decorated with isoxazoline and methylpyrolidine-2,5-dione ring. J Mol Structure. Jun. 10, 2013;1041:164-174.
Zhou et al., Targeting RNA-splicing for SMA treatment. Mol Cells. Mar. 2012;33(3):223-8. doi: 10.1007/s10059-012-0005-6.
EP 13790819.0, Jan. 8, 2016, Extended European Search Report.
Alvarez-Salas, Nucleic acids as therapeutic agents. Curr Top Med Chem. 2008;8(15):1379-404.

\* cited by examiner

COMPOSITIONS AND METHODS FOR MODULATING SMN GENE FAMILY EXPRESSION

CROSS-REFERENCE TO RELATED APPLICATIONS

This application is a national stage filing under U.S.C. § 371 of PCT International Application PCT/US2013/041440, with an international filing date of May 16, 2013, which claims the benefit under 35 U.S.C. § 119(e) of U.S. Provisional Application No. 61/785,529, entitled "COMPOSITIONS AND METHODS FOR MODULATING SMN GENE FAMILY EXPRESSION", filed Mar. 14, 2013; U.S. Provisional Application No. 61/719,394, entitled "COMPOSITIONS AND METHODS FOR MODULATING SMN GENE FAMILY EXPRESSION", filed Oct. 27, 2012; and U.S. Provisional Application No. 61/647,858, entitled "COMPOSITIONS AND METHODS FOR MODULATING SMN GENE FAMILY EXPRESSION", filed May 16, 2012, the contents of each of which are incorporated herein by reference in their entireties.

FIELD OF THE INVENTION

The invention relates to oligonucleotide based compositions, as well as methods of using oligonucleotide based compositions for treating disease.

BACKGROUND OF THE INVENTION

Spinal muscular atrophy (SMA) is a group of hereditary diseases that causes muscle damage leading to impaired muscle function, difficulty breathing, frequent respiratory infection, and eventually death. There are four types of SMA that are classified based on the onset and severity of the disease. SMA type I is the most severe form and is one of the most common causes of infant mortality, with symptoms of muscle weakness and difficulty breathing occurring at birth. SMA type II occurs later, with muscle weakness and other symptoms developing from ages 6 month to 2 years. Symptoms appear in SMA type III during childhood and in SMA type IV, the mildest form, during adulthood. All four types of SMA have been found to be associated with mutations in the SMN gene family, particularly SMN1.

Survival of motor neuron (SMN) is a protein involved in transcriptional splicing through its involvement in assembly of small nuclear ribonucleoproteins (snRNPs). snRNPs are protein-RNA complexes that bind with pre-mRNA to form a spliceosome, which then splices the pre-mRNA, most often resulting in removal of introns. Three genes encode SMN or a variant of SMN, including SMN1 (survival of motor neuron 1, telomeric), SMN2 (survival of motor neuron 2, centromeric), and SMNP (survival of motor neuron 1, telomeric pseudogene). SMN1 and SMN2 are a result of a gene duplication at 5q13 in humans. A lack of SMN activity results in widespread splicing defects, especially in spinal motor neurons, and degeneration of the spinal cord lower motor neurons.

SUMMARY OF THE INVENTION

Aspects of the invention disclosed herein provide methods and compositions that are useful for upregulating the expression of certain genes in cells. In some embodiments, single stranded oligonucleotides are provided that target a PRC2-associated region of a gene and thereby cause upregulation of the gene. Also provided herein are methods and related single stranded oligonucleotides that are useful for selectively inducing expression of particular splice variants of genes. In some embodiments, the methods are useful for controlling the levels in a cell of particular protein isoforms encoded by the splice variants. In some cases, the methods are useful for inducing expression of proteins to levels sufficient to treat disease.

In some embodiments, single stranded oligonucleotides are provided that target a PRC2-associated region of a SMN gene (e.g., human SMN1, human SMN2) and thereby cause upregulation of the gene. For example, according to some aspects of the invention methods are provided for increasing expression of full-length SMN protein in a cell for purposes of treating SMA. Accordingly, aspects of the invention disclosed herein provide methods and compositions that are useful for upregulating SMN1 or SMN2 in cells. In some embodiments, single stranded oligonucleotides are provided that target a PRC2-associated region of the gene encoding SMN1 or SMN2. In some embodiments, these single stranded oligonucleotides activate or enhance expression of SMN1 or SMN2 by relieving or preventing PRC2 mediated repression of SMN1 or SMN2.

In some embodiments, the methods comprise delivering to the cell a first single stranded oligonucleotide complementary with a PRC2-associated region of an SMN gene, e.g., a PRC2-associated region of SMN1 or SMN2, and a second single stranded oligonucleotide complementary with a splice control sequence of a precursor mRNA of an SMN gene, e.g., a precursor mRNA of SMN1 or SMN2, in amounts sufficient to increase expression of a mature mRNA of SMN1 or SMN2 that comprises (or includes) exon 7 in the cell.

According to some aspects of the invention single stranded oligonucleotides are provided that have a region of complementarity that is complementary with (e.g., at least 8 consecutive nucleotides of) a PRC2-associated region of an SMN gene, e.g., a PRC2-associated region of the nucleotide sequence set forth as SEQ ID NO: 1, 2, 4, or 5. In some embodiments, the oligonucleotide has at least one of the following features: a) a sequence that is 5'X-Y-Z, in which X is any nucleotide and in which X is at the 5' end of the oligonucleotide, Y is a nucleotide sequence of 6 nucleotides in length that is not a human seed sequence of a microRNA, and Z is a nucleotide sequence of 1 to 23 nucleotides in length; b) a sequence that does not comprise three or more consecutive guanosine nucleotides; c) a sequence that has less than a threshold level of sequence identity with every sequence of nucleotides, of equivalent length to the second nucleotide sequence, that are between 50 kilobases upstream of a 5'-end of an off-target gene and 50 kilobases downstream of a 3'-end of the off-target gene; d) a sequence that is complementary to a PRC2-associated region that encodes an RNA that forms a secondary structure comprising at least two single stranded loops; and e) a sequence that has greater than 60% G-C content. In some embodiments, the single stranded oligonucleotide has at least two of features a), b), c), d), and e), each independently selected. In some embodiments, the single stranded oligonucleotide has at least three of features a), b), c), d), and e), each independently selected. In some embodiments, the single stranded oligonucleotide has at least four of features a), b), c), d), and e), each independently selected. In some embodiments, the single stranded oligonucleotide has each of features a), b), c), d), and e). In certain embodiments, the oligonucleotide has the sequence 5'X-Y-Z, in which the oligonucleotide is 8-50 nucleotides in length.

According to some aspects of the invention, single stranded oligonucleotides are provided that have a sequence X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with a PRC2-associated region of an SMN gene, e.g., a PRC2-associated region of the nucleotide sequence set forth as SEQ ID NO: 1, 2, 4, or 5. In some aspects of the invention, single stranded oligonucleotides are provided that have a sequence 5'-X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with at least 8 consecutive nucleotides of a PRC2-associated region of an SMN gene, e.g., a PRC2-associated region of the nucleotide sequence set forth as SEQ ID NO: 1, 2, 4, or 5. In some embodiments, Y is a sequence selected from Table 1. In some embodiments, the PRC2-associated region is a sequence listed in any one of SEQ ID NOS: 9 to 18.

In some embodiments, the single stranded oligonucleotide comprises a nucleotide sequence as set forth in any one of SEQ ID NOS: 30 to 13087, or a fragment thereof that is at least 8 nucleotides. In some embodiments, the single stranded oligonucleotide comprises a nucleotide sequence as set forth in any one of SEQ ID NOS: 30 to 13087, in which the 5' end of the nucleotide sequence provided is the 5' end of the oligonucleotide. In some embodiments, the region of complementarity (e.g., the at least 8 consecutive nucleotides) is also present within the nucleotide sequence set forth as SEQ ID NO: 7 or 8.

In some embodiments, a PRC2-associated region is a sequence listed in any one of SEQ ID NOS: 9 to 14. In some embodiments, the single stranded oligonucleotide comprises a nucleotide sequence as set forth in any one of SEQ ID NOS: 30 to 8329 and 13093 to 13094 or a fragment thereof that is at least 8 nucleotides. In some embodiments, the single stranded oligonucleotide comprises a nucleotide sequence as set forth in any one of SEQ ID NOS: 30 to 8329 and 13093 to 13094, wherein the 5' end of the nucleotide sequence provided is the 5' end of the oligonucleotide. In some embodiments, the at least 8 consecutive nucleotides are also present within the nucleotide sequence set forth as SEQ ID NO: 7.

In some embodiments, a PRC2-associated region is a sequence listed in any one of SEQ ID NOS: 15 to 18. In some embodiments, the single stranded oligonucleotide comprises a nucleotide sequence as set forth in any one of SEQ ID NOS: 1158-1159, 1171, 1482-1483, 1485-1486, 2465-2471, 2488-2490, 2542-2546, 2656-2657, 2833-2835, 3439-3440, 3916-3918, 4469-4472, 4821, 5429, 5537, 6061, 7327, 8330-13061, and 13062-13087 or a fragment thereof that is at least 8 nucleotides. In some embodiments, the at least 8 consecutive nucleotides are present within the nucleotide sequence set forth as SEQ ID NO: 8.

In some embodiments, the single stranded oligonucleotide comprises a nucleotide sequence as set forth in any one of SEQ ID NOS: 30 to 13087. In some embodiments, the oligonucleotide is up to 50 nucleotides in length. In some embodiments, the single stranded oligonucleotide comprises a fragment of at least 8 nucleotides of a nucleotide sequence as set forth in any one of SEQ ID NOS: 30 to 13087.

In some embodiments, a single stranded oligonucleotide comprises a nucleotide sequence as set forth in Table 4. In some embodiments, the single stranded oligonucleotide comprises a fragment of at least 8 nucleotides of a nucleotide sequence as set forth in Table 4. In some embodiments, a single stranded oligonucleotide consists of a nucleotide sequence as set forth in Table 4.

According to some aspects of the invention, compounds are provided that comprise the general formula A-B-C, wherein A is a single stranded oligonucleotide complementary with at least 8 consecutive nucleotides of a PRC2-associated region of a gene, B is a linker, and C is a single stranded oligonucleotide complementary to a splice control sequence of a precursor mRNA of the gene. In some embodiments, B comprises an oligonucleotide, peptide, low pH labile bond, or disulfide bond. In some embodiments, the splice control sequence resides in an exon of the gene. In some embodiments, the splice control sequence traverses an intron-exon junction of the gene. In some embodiments, the splice control sequence resides in an intron of the gene. In some embodiments, the splice control sequence comprises at least one hnRNAP binding sequence. In some embodiments, hybridization of an oligonucleotide having the sequence of C with the splice control sequence of the precursor mRNA in a cell results in inclusion of a particular exon in a mature mRNA that arises from processing of the precursor mRNA in the cell. In some embodiments, hybridization of an oligonucleotide having the sequence of C with the splice control sequence of the precursor mRNA in a cell results in exclusion of a particular intron or exon in a mature mRNA that arises from processing of the precursor mRNA in the cell.

In some embodiments, the gene is SMN1 or SMN2. In some embodiments, the splice control sequence resides in intron 6, intron 7, exon 7, exon 8 or at the junction of intron 7 and exon 8 of SMN1 or SMN2. In some embodiments, the splice control sequence comprises the sequence: CAG-CAUUAUGAAAG (SEQ ID NO: 13100). In some embodiments, B comprises a sequence selected from: TCACTTTCATAATGCTGG (SEQ ID NO: 13088); TCACTTTCATAATGC (SEQ ID NO: 13089); CACTTTCATAATGCT (SEQ ID NO: 13090); ACTTTCATAATGCTG (SEQ ID NO: 13090); and CTTTCATAATGCTGG (SEQ ID NO: 13092).

In some embodiments, A has a sequence 5'-X-Y-Z, wherein X is any nucleotide, Y is a nucleotide sequence of 6 nucleotides in length that is not a seed sequence of a human microRNA, and Z is a nucleotide sequence of 1-23 nucleotides in length. In some embodiments, the PRC2-associated region of an SMN2 gene is a PRC2-associated region within SEQ ID NO: 1, 2, 4 or 5. In some embodiments, Y is a sequence selected from Table 1. In some embodiments, the PRC2-associated region is a sequence set forth in any one of SEQ ID NOS: 9 to 23. In some embodiments, A comprises a nucleotide sequence as set forth in any one of SEQ ID NOS: 30 to 8329 and 13088 to 13094 or a fragment thereof that is at least 8 nucleotides. In some embodiments, A comprises a nucleotide sequence as set forth in any one of SEQ ID NOS: 30 to 8329 and 13088 to 13094, wherein the 5' end of the nucleotide sequence provided is the 5' end of A. In some embodiments, the at least 8 consecutive nucleotides are also present within the nucleotide sequence set forth as SEQ ID NO: 7. In some embodiments, the PRC2-associated region is a sequence set forth in any one of SEQ ID NOS: 24 to 29.

In some embodiments, A comprises a nucleotide sequence as set forth in any one of SEQ ID NOS: 1158-1159, 1171, 1482-1483, 1485-1486, 2465-2471, 2488-2490, 2542-2546, 2656-2657, 2833-2835, 3439-3440, 3916-3918, 4469-4472, 4821, 5429, 5537, 6061, 7327, 8330-13061, and 13062-

13087 or a fragment thereof that is at least 8 nucleotides. In some embodiments, the at least 8 consecutive nucleotides are present within the nucleotide sequence set forth as SEQ ID NO: 8. In some embodiments, A does not comprise three or more consecutive guanosine nucleotides. In some embodiments, A does not comprise four or more consecutive guanosine nucleotides. In some embodiments, A or C is 8 to 30 nucleotides in length. In some embodiments, A is 8 to 10 nucleotides in length and all but 1, 2, or 3 of the nucleotides of the complementary sequence of the PRC2-associated region are cytosine or guanosine nucleotides. In some embodiments, B is an oligonucleotide comprising 1 to 10 thymidines or uridines. In some embodiments, B is more susceptible to cleavage in a mammalian extract than A and C.

In some embodiments, A comprises a nucleotide sequence selected from GCTUTGGGAAGUAUG (SEQ ID NO: 11394), CUTUGGGAAGTATG (SEQ ID NO: 11395) and GGTACATGAGTGGCT (SEQ ID NO: 11419); B comprises the nucleotide sequence TTTT or UUUU; and C comprises the nucleotide sequence TCACTTTCATAATGCTGG (SEQ ID NO: 13088); TCACTTTCATAATGC (SEQ ID NO: 13089); CACTTTCATAATGCT (SEQ ID NO: 13090); ACTTTCATAATGCTG (SEQ ID NO: 13091); or CTTTCATAATGCTGG (SEQ ID NO: 13092), and wherein the 3' end of A is linked to the 5' end of B, and the 3' end of B is linked to 5' end of C.

In some embodiments, the single stranded oligonucleotide does not comprise three or more consecutive guanosine nucleotides. In some embodiments, the single stranded oligonucleotide does not comprise four or more consecutive guanosine nucleotides.

In some embodiments, the single stranded oligonucleotide is 8 to 30 nucleotides in length. In some embodiments, the single stranded oligonucleotide is up to 50 nucleotides in length. In some embodiments, the single stranded oligonucleotide is 8 to 10 nucleotides in length and all but 1, 2, or 3 of the nucleotides of the complementary sequence of the PRC2-associated region are cytosine or guanosine nucleotides.

In some embodiments, the single stranded oligonucleotide is complementary with at least 8 consecutive nucleotides of a PRC2-associated region of an SMN gene, e.g., a PRC2-associated region of a nucleotide sequence set forth as SEQ ID NO: 1, 2, 4, or 5, in which the nucleotide sequence of the single stranded oligonucleotide comprises one or more of a nucleotide sequence selected from the group consisting of (a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXxXx, (X)XxxXXx (X)XxxxXX, (X)xXxXxX, (X)xXxxXX, (X)xxXxXX, (X)xXxXxX and (X)XxXxXx, (d) (X)xxXXX, (X)xXxXXX, (X)xXXxXX, (X)xXXXxX, (X)xXXXXx, (X)XxxXXX, (X)XxXxXX, (X)XxXXxX, (X)XxXXXx, (X)XXxxXX, (X)XXxXxX, (X)XXxXXx, (X)XXXxxX, (X)XXXxXx, (X)XXXXxx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, wherein "X" denotes a nucleotide analogue, (X) denotes an optional nucleotide analogue, and "x" denotes a DNA or RNA nucleotide unit.

In some embodiments, at least one nucleotide of the oligonucleotide is a nucleotide analogue. In some embodiments, the at least one nucleotide analogue results in an increase in Tm of the oligonucleotide in a range of 1 to 5° C. compared with an oligonucleotide that does not have the at least one nucleotide analogue.

In some embodiments, at least one nucleotide of the oligonucleotide comprises a 2' O-methyl. In some embodiments, each nucleotide of the oligonucleotide comprises a 2' O-methyl. In some embodiments, the oligonucleotide comprises at least one ribonucleotide, at least one deoxyribonucleotide, or at least one bridged nucleotide. In some embodiments, the bridged nucleotide is a LNA nucleotide, a cEt nucleotide or a ENA modified nucleotide. In some embodiments, each nucleotide of the oligonucleotide is a LNA nucleotide.

In some embodiments, the nucleotides of the oligonucleotide comprise alternating deoxyribonucleotides and 2'-fluoro-deoxyribonucleotides. In some embodiments, the nucleotides of the oligonucleotide comprise alternating deoxyribonucleotides and 2'-O-methyl nucleotides. In some embodiments, the nucleotides of the oligonucleotide comprise alternating deoxyribonucleotides and ENA nucleotide analogues. In some embodiments, the nucleotides of the oligonucleotide comprise alternating deoxyribonucleotides and LNA nucleotides. In some embodiments, the 5' nucleotide of the oligonucleotide is a deoxyribonucleotide. In some embodiments, the nucleotides of the oligonucleotide comprise alternating LNA nucleotides and 2'-O-methyl nucleotides. In some embodiments, the 5' nucleotide of the oligonucleotide is a LNA nucleotide. In some embodiments, the nucleotides of the oligonucleotide comprise deoxyribonucleotides flanked by at least one LNA nucleotide on each of the 5' and 3' ends of the deoxyribonucleotides.

In some embodiments, the single stranded oligonucleotide comprises modified internucleotide linkages (e.g., phosphorothioate internucleotide linkages or other linkages) between at least two, at least three, at least four, at least five or more nucleotides. In some embodiments, the single stranded oligonucleotide comprises modified internucleotide linkages (e.g., phosphorothioate internucleotide linkages or other linkages) between between all nucleotides.

In some embodiments, the nucleotide at the 3' position of the oligonucleotide has a 3' hydroxyl group. In some embodiments, the nucleotide at the 3' position of the oligonucleotide has a 3' thiophosphate. In some embodiments, the single stranded oligonucleotide has a biotin moiety or other moiety conjugated to its 5' or 3' nucleotide. In some embodiments, the single stranded oligonucleotide has cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

According to some aspects of the invention compositions are provided that comprise any of the oligonucleotides disclosed herein, and a carrier. In some embodiments, compositions are provided that comprise any of the oligonucleotides in a buffered solution. In some embodiments, the oligonucleotide is conjugated to the carrier. In some embodiments, the carrier is a peptide. In some embodiments, the carrier is a steroid. According to some aspects of the invention pharmaceutical compositions are provided that comprise any of the oligonucleotides disclosed herein, and a pharmaceutically acceptable carrier.

According to other aspects of the invention, kits are provided that comprise a container housing any of the compositions disclosed herein.

According to some aspects of the invention, methods of increasing expression of SMN1 or SMN2 in a cell are provided. In some embodiments, the methods involve delivering any one or more of the single stranded oligonucleotides disclosed herein into the cell. In some embodiments, delivery of the single stranded oligonucleotide into the cell results in a level of expression of SMN1 or SMN2 that is greater (e.g., at least 50% greater) than a level of expression of SMN1 or SMN2 in a control cell that does not comprise the single stranded oligonucleotide.

According to some aspects of the invention, methods of increasing levels of SMN1 or SMN2 in a subject are provided. According to some aspects of the invention, methods of treating a condition (e.g., Spinal muscular atrophy) associated with decreased levels of SMN1 or SMN2 in a subject are provided. In some embodiments, the methods involve administering any one or more of the single stranded oligonucleotides disclosed herein to the subject.

Aspects of the invention relate to methods of increasing expression of SMN protein in a cell. In some embodiments, the method comprise delivering to the cell a first single stranded oligonucleotide complementary with at least 8 consecutive nucleotides of a PRC2-associated region of SMN2 and a second single stranded oligonucleotide complementary with a splice control sequence of a precursor mRNA of SMN2, in amounts sufficient to increase expression of a mature mRNA of SMN2 that comprises exon 7 in the cell. In some embodiments, the region of complementarity with at least 8 consecutive nucleotides of a PRC2-associated region of SMN2 has at least 1, at least 2, at least 3, at least 4, at least 5, at least 6, at least 7, at least 8, or more mismatches with a corresponding region of SMN1. As used herein the term, "splice control sequence" refers to a nucleotide sequence that when present in a precursor mRNA influences splicing of that precursor mRNA in a cell. In some embodiments, a splice control sequence includes one or more binding sites for a molecule that regulates mRNA splicing, such as a hnRNAP protein. In some embodiments, a splice control sequence comprises the sequence CAG or AAAG. In some embodiments, a splice control sequence resides in an exon (e.g., an exon of SMN1 or SMN2, such as exon 7 or exon 8). In some embodiments, a splice control sequence traverses an intron-exon junction (e.g., an intron-exon junction of SMN1 or SMN2, such as the intron 6/exon 7 junction or the intron 7/exon 8 junction). In some embodiments, a splice control sequence resides in an intron (e.g., an intron of SMN1 or SMN2, such as intron 6 or intron 7). In some embodiments, a splice control sequence comprises the sequence: CAGCAUUAUGAAAG (SEQ ID NO: 13100) or a portion thereof.

In some embodiments, the second single stranded oligonucleotide is splice switching oligonucleotide that comprises a sequence selected from: TCACTTTCATAAT-GCTGG (SEQ ID NO: 13088); TCACTTTCATAATGC (SEQ ID NO: 13089); CACTTTCATAATGCT (SEQ ID NO: 13090); ACTTTCATAATGCTG (SEQ ID NO: 13091); and CTTTCATAATGCTGG (SEQ ID NO: 13092). In some embodiments, the second single stranded oligonucleotide is 8 to 30 nucleotides in length.

In some embodiments, the first single stranded oligonucleotide has a sequence 5'-X-Y-Z, wherein X is any nucleotide, Y is a nucleotide sequence of 6 nucleotides in length that is not a seed sequence of a human microRNA, and Z is a nucleotide sequence of 1-23 nucleotides in length.

In some embodiments, the PRC2-associated region of an SMN2 gene is a PRC2-associated region within SEQ ID NO: 1, 2, 4 or 5. In some embodiments, Y is a sequence selected from Table 1. In some embodiments, the PRC2-associated region is a sequence set forth in any one of SEQ ID NOS: 9 to 23. In some embodiments, the first single stranded oligonucleotide comprises a nucleotide sequence as set forth in any one of SEQ ID NOS: 30 to 8329 and 13088 to 13094 or a fragment thereof that is at least 8 nucleotides. In some embodiments, the first single stranded oligonucleotide comprises a nucleotide sequence as set forth in any one of SEQ ID NOS: 30 to 8329 and 13088 to 13094, wherein the 5' end of the nucleotide sequence provided is the 5' end of the first single stranded oligonucleotide. In some embodiments, the at least 8 consecutive nucleotides are also present within the nucleotide sequence set forth as SEQ ID NO: 7.

In some embodiments, the PRC2-associated region is a sequence set forth in any one of SEQ ID NOS: 24 to 29. In some embodiments, the first single stranded oligonucleotide comprises a nucleotide sequence as set forth in any one of SEQ ID NOS: 1158-1159, 1171, 1482-1483, 1485-1486, 2465-2471, 2488-2490, 2542-2546, 2656-2657, 2833-2835, 3439-3440, 3916-3918, 4469-4472, 4821, 5429, 5537, 6061, 7327, 8330-13061, and 13062-13087 or a fragment thereof that is at least 8 nucleotides. In some embodiments, the at least 8 consecutive nucleotides are present within the nucleotide sequence set forth as SEQ ID NO: 8. In some embodiments, the first single stranded oligonucleotide does not comprise three or more consecutive guanosine nucleotides. In some embodiments, the first single stranded oligonucleotide does not comprise four or more consecutive guanosine nucleotides. In some embodiments, the first single stranded oligonucleotide is 8 to 30 nucleotides in length. In some embodiments, the first single stranded oligonucleotide is 8 to 10 nucleotides in length and all but 1, 2, or 3 of the nucleotides of the complementary sequence of the PRC2-associated region are cytosine or guanosine nucleotides.

In some embodiments, the first single stranded oligonucleotide and the second single stranded oligonucleotide are delivered to the cell simultaneously. In some embodiments, the cell is in a subject and the step of delivering to the cell comprises administering the first single stranded oligonucleotide and the second single stranded oligonucleotide to the subject as a co-formulation. In some embodiments, the first single stranded oligonucleotide is covalently linked to the second single stranded oligonucleotide through a linker. In some embodiments, the linker comprises an oligonucleotide, a peptide, a low pH-labile bond, or a disulfide bond. In some embodiments, the linker comprises an oligonucleotide, optionally wherein the oligonucleotide comprises 1 to 10 thymidines or uridines. In some embodiments, the linker is more susceptible to cleavage in a mammalian extract than the first and second single stranded oligonucleotides. In some embodiments, the first single stranded oligonucleotide is not covalently linked to the second single stranded oligonucleotide. In some embodiments, the first single stranded oligonucleotide and the second single stranded oligonucleotide are delivered to the cell separately.

According to some aspects of the invention, methods are provided for treating spinal muscular atrophy in a subject. The methods, in some embodiments, comprise administering to the subject a first single stranded oligonucleotide complementary with at least 8 consecutive nucleotides of a PRC2-associated region of SMN2 and a second single stranded oligonucleotide complementary with a splice control sequence of a precursor mRNA of SMN2, in amounts sufficient to increase expression of SMN protein in the subject.

According to some aspects of the invention methods are provided for treating spinal muscular atrophy in a subject that involve administering to the subject a first single stranded oligonucleotide complementary with a PRC2-associated region of SMN2 and a second single stranded oligonucleotide complementary with a splice control sequence of a precursor mRNA of SMN2, in amounts sufficient to increase expression of SMN protein in the subject. Related compositions are also provided. In some embodiments, compositions are provided that comprise a first single stranded oligonucleotide complementary with at least 8 consecutive nucleotides of a PRC2-associated region of SMN2, and a second single stranded oligonucleotide complementary to a splice control sequence of a precursor mRNA of SMN2. In some embodiments, compositions are provided that comprise a single stranded oligonucleotide complementary with at least 8 consecutive nucleotides of a PRC2-associated region of a gene, linked via a linker to a single stranded oligonucleotide complementary to a splice control sequence of a precursor mRNA of the gene. Related kits comprising single stranded oligonucleotides that regulate SMN1 or SMN2 expression are also provided.

According to some aspects of the invention compositions are provided that comprise any of the oligonucleotides or compounds disclosed herein, and a carrier. In some embodiments, compositions are provided that comprise any of the oligonucleotides or compounds in a buffered solution. In some embodiments, the oligonucleotide is conjugated to the carrier. In some embodiments, the carrier is a peptide. In some embodiments, the carrier is a steroid. According to some aspects of the invention pharmaceutical compositions are provided that comprise any of the oligonucleotides disclosed herein, and a pharmaceutically acceptable carrier.

According to some aspects of the invention, compositions are provided that comprise a first single stranded oligonucleotide complementary with at least 8 consecutive nucleotides of a PRC2-associated region of SMN2, and a second single stranded oligonucleotide complementary to a splice control sequence of a precursor mRNA of SMN2. In some embodiments, the splice control sequence resides in an exon of SMN2. In some embodiments, the exon is exon 7 or exon 8. In some embodiments, the splice control sequence traverses an intron-exon junction of SMN2. In some embodiments, the intron-exon junction is the intron 6/exon 7 junction or the intron 7/exon 8 junction. In some embodiments, the splice control sequence resides in an intron of SMN2. In some embodiments, the intron is intron 6 or intron 7 (SEQ ID NO: 13101). In some embodiments, the splice control sequence comprises the sequence: CAGCAUUAUGAAAG (SEQ ID NO: 13100) or a portion thereof. In some embodiments, the splice control sequence comprises at least one hnRNAP binding sequence. In some embodiments, the second single stranded oligonucleotide comprises a sequence selected from: TCACTTTCATAATGCTGG (SEQ ID NO: 13088); TCACTTTCATAATGC (SEQ ID NO: 13089); CACTTTCATAATGCT (SEQ ID NO: 13090); ACTTTCATAATGCTG (SEQ ID NO: 13091); and CTTTCATAATGCTGG (SEQ ID NO: 13092). In some embodiments, the first single stranded oligonucleotide has a sequence 5'-X-Y-Z, wherein X is any nucleotide, Y is a nucleotide sequence of 6 nucleotides in length that is not a seed sequence of a human microRNA, and Z is a nucleotide sequence of 1-23 nucleotides in length. In some embodiments, the PRC2-associated region of SMN2 is a PRC2-associated region within SEQ ID NO: 1, 2, 4 or 5. In some embodiments, Y is a sequence selected from Table 1. In some embodiments, the PRC2-associated region is a sequence set forth in any one of SEQ ID NOS: 9 to 23. In some embodiments, the first single stranded oligonucleotide comprises a nucleotide sequence as set forth in any one of SEQ ID NOS: 30 to 8329 and 13093 to 13094 or a fragment thereof that is at least 8 nucleotides. In some embodiments, the first single stranded oligonucleotide comprises a nucleotide sequence as set forth in any one of SEQ ID NOS: 30 to 8329 and 13093 to 13094, wherein the 5' end of the nucleotide sequence provided is the 5' end of the first single stranded oligonucleotide. In some embodiments, the at least 8 consecutive nucleotides are also present within the nucleotide sequence set forth as SEQ ID NO: 7. In some embodiments, the PRC2-associated region is a sequence set forth in any one of SEQ ID NOS: 24 to 29. In some embodiments, the first single stranded oligonucleotide comprises a nucleotide sequence as set forth in any one of SEQ ID NOS: 1158-1159, 1171, 1482-1483, 1485-1486, 2465-2471, 2488-2490, 2542-2546, 2656-2657, 2833-2835, 3439-3440, 3916-3918, 4469-4472, 4821, 5429, 5537, 6061, 7327, 8330-13061, and 13062-13087 or a fragment thereof that is at least 8 nucleotides. In some embodiments, the at least 8 consecutive nucleotides are present within the nucleotide sequence set forth as SEQ ID NO: 8. In some embodiments, the first single stranded oligonucleotide does not comprise three or more consecutive guanosine nucleotides. In some embodiments, the first single stranded oligonucleotide does not comprise four or more consecutive guanosine nucleotides. In some embodiments, the first and/or second single stranded oligonucleotide is 8 to 30 nucleotides in length. In some embodiments, the first single stranded oligonucleotide is 8 to 10 nucleotides in length and all but 1, 2, or 3 of the nucleotides of the complementary sequence of the PRC2-associated region are cytosine or guanosine nucleotides. In some embodiments, the first single stranded oligonucleotide is covalently linked to the second single stranded oligonucleotide through a linker. In some embodiments, the linker comprises an oligonucleotide, a peptide, a low pH-labile bond, or a disulfide bond. In some embodiments, the linker comprises an oligonucleotide, optionally wherein the oligonucleotide comprises 1 to 10 thymidines or uridines. In some embodiments, the linker is more susceptible to cleavage in a mammalian extract than the first and second single stranded oligonucleotides. In some embodiments, the first single stranded oligonucleotide is not covalently linked to the second single stranded oligonucleotide. In some embodiments, the composition further comprises a carrier. In some embodiments, the carrier is a pharmaceutically acceptable carrier.

Further aspects of the invention provide methods for selecting oligonucleotides for activating or enhancing expression of SMN1 or SMN2. In some embodiments, methods are provided for selecting a set of oligonucleotides that is enriched in candidates (e.g., compared with a random selection of oligonucleotides) for activating or enhancing expression of SMN1 or SMN2. Accordingly, the methods may be used to establish sets of clinical candidates that are enriched in oligonucleotides that activate or enhance expression of SMN1 or SMN2. Such libraries may be utilized, for example, to identify lead oligonucleotides for developing therapeutics to treat SMN1 or SMN2. Furthermore, in some embodiments, oligonucleotide chemistries are provided that are useful for controlling the pharmacokinetics, biodistribution, bioavailability and/or efficacy of the single stranded oligonucleotides for activating expression of SMN1 or SMN2.

According to other aspects of the invention, kits are provided that comprise a container housing any of the compositions disclosed herein. According to other aspects of the invention, kits are provided that comprise a first container housing first single stranded oligonucleotide complementary with at least 8 consecutive nucleotides of a PRC2-associated region of a gene; and a second container housing a second single stranded oligonucleotide complementary to a splice control sequence of a precursor mRNA of the gene. In some embodiments, the splice control sequence resides in an exon of the gene. In some embodiments, the splice control sequence traverses an intron-exon junction of the gene. In some embodiments, the splice control sequence resides in an intron of the gene. In some embodiments, the splice control sequence comprises at least one hnRNAP binding sequence. In some embodiments, hybridization of an oligonucleotide having the sequence of C with the splice control sequence of the precursor mRNA in a cell results in inclusion of a particular exon in a mature mRNA that arises from processing of the precursor mRNA in the cell. In some embodiments, hybridization of an oligonucleotide having the sequence of C with the splice control sequence of the precursor mRNA in a cell results in exclusion of a particular intron or exon in a mature mRNA that arises from processing of the precursor mRNA in the cell. In some embodiments, the gene is SMN1 or SMN2. In some embodiments, the splice control sequence resides in intron 6, intron 7, exon 7, exon 8 or at the junction of intron 7 and exon 8. In some embodiments, the splice control sequence comprises the sequence: CAGCAUUAUGAAAG (SEQ ID NO: 13100). In some embodiments, the second single stranded oligonucleotide comprises a sequence selected from: TCACTTTCATAATGCTGG (SEQ ID NO: 13088); TCACTTTCATAATGC (SEQ ID NO: 13089); CACTTTCATAATGCT (SEQ ID NO: 13090); ACTTTCATAATGCTG (SEQ ID NO: XX); and CTTTCATAATGCTGG (SEQ ID NO: 13091). In some embodiments, the first single stranded oligonucleotide has a sequence 5'-X-Y-Z, wherein X is any nucleotide, Y is a nucleotide sequence of 6 nucleotides in length that is not a seed sequence of a human microRNA, and Z is a nucleotide sequence of 1-23 nucleotides in length. In some embodiments, the PRC2-associated region of an SMN2 gene is a PRC2-associated region within SEQ ID NO: 1, 2, 4 or 5. In some embodiments, Y is a sequence selected from Table 1. In some embodiments, the PRC2-associated region is a sequence set forth in any one of SEQ ID NOS: 9 to 23. In some embodiments, the first single stranded oligonucleotide comprises a nucleotide sequence as set forth in any one of SEQ ID NOS: 30 to 8329 and 13093 to 13094 or a fragment thereof that is at least 8 nucleotides. In some embodiments, the first single stranded oligonucleotide comprises a nucleotide sequence as set forth in any one of SEQ ID NOS: 30 to 8329 and 13093 to 13094, wherein the 5' end of the nucleotide sequence provided is the 5' end of the first single stranded oligonucleotide. In some embodiments, the at least 8 consecutive nucleotides are also present within the nucleotide sequence set forth as SEQ ID NO: 7. In some embodiments, the PRC2-associated region is a sequence set forth in any one of SEQ ID NOS: 24 to 29. In some embodiments, the first single stranded oligonucleotide comprises a nucleotide sequence as set forth in any one of SEQ ID NOS: 1158-1159, 1171, 1482-1483, 1485-1486, 2465-2471, 2488-2490, 2542-2546, 2656-2657, 2833-2835, 3439-3440, 3916-3918, 4469-4472, 4821, 5429, 5537, 6061, 7327, 8330-13061, and 13062-13087 or a fragment thereof that is at least 8 nucleotides. In some embodiments, the at least 8 consecutive nucleotides are present within the nucleotide sequence set forth as SEQ ID NO: 8.

BRIEF DESCRIPTION OF TABLES

Figure 1:
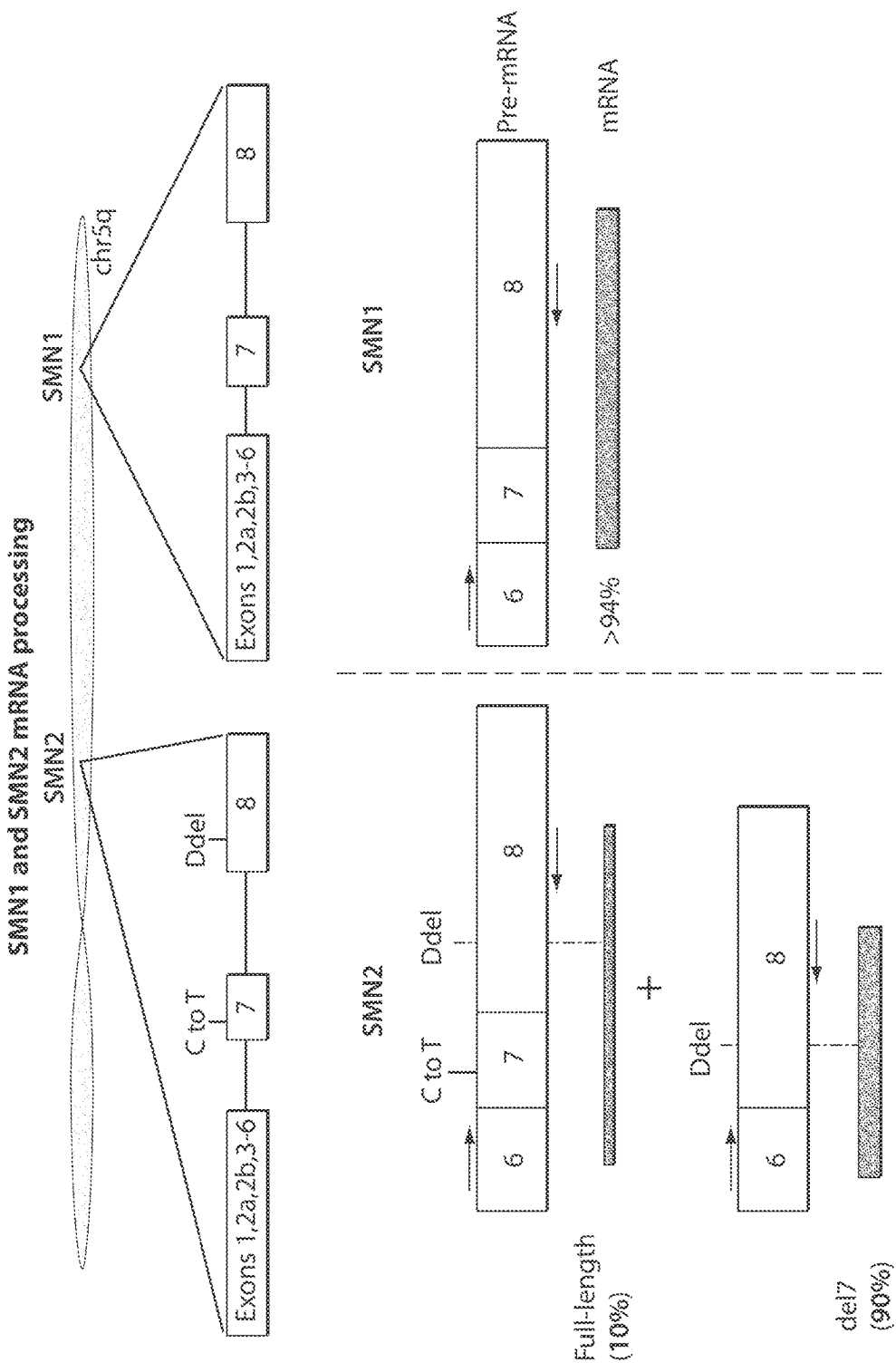
FIG. 1 provides a schematic of SMN1 and SMN2 mRNA processing

Table 1: Hexamers that are not seed sequences of human miRNAs

Table 2: Oligonucleotide sequences made for testing in the lab. RQ (column 2) and RQ SE (column 3) shows the activity of the oligo relative to a control well (usually carrier alone) and the standard error or the triplicate replicates of the experiment. [oligo] is shown in nanomolar for in vitro experiments and in milligrams per kilogram of body weight for in vivo experiments.

Table 3: A listing of oligonucleotide modifications

Table 4: Oligonucleotide sequences made for testing human cells obtained from subjects with Spinal Muscular Atrophy. The table shows the sequence of the modified nucleotides, where lnaX represents an LNA nucleotide with 3' phosphorothioate linkage, omeX is a 2'-O-methyl nucleotide, dX is a deoxy nucleotide. An s at the end of a nucleotide code indicates that the nucleotide had a 3' phosphorothioate linkage. The "-Sup" at the end of the sequence marks the fact that the 3' end lacks either a phosphate or thiophosphate on the 3' linkage. The Formatted Sequence column shows the sequence of the oligonucleotide, including modified nucleotides, for the oligonucleotides tested in Table 2, 5, 6 and 7.

Table 8: Cell lines

BRIEF DESCRIPTION OF THE APPENDICES

Appendix A; Appendix A contains Table 5, which shows RT-PCR data from testing of different oligonucleotides.

Appendix B; Appendix B contains Table 6, which shows RT-PCR data from testing of different combination treatments (e.g., two oligonucleotides, an oligonucleotide and a drug).

Appendix C; Appendix C contains Table 7, which shows ELISA data from testing of different oligonucleotides Note the following column information for Tables 5-7 in Appendices A-C, respectively. SEQID: sequence identifier of base sequence of oligonucleotide used; Oligo Name: name of oligonucleotide; Avg RQ: average relative quantification of RT-PCR based expression levels of target gene(s); Avg RQ SE: standard error of mean of relative quantification of RT-PCR based expression level; "% SMN over lipo only control" refers to the ratio of SMN protein levels (ng/mg total protein) when compared to Lipofectamine2000 (transfection reagent) treated cells converted into %; "% SMN CVV" refers to coefficient of variation; Exp #: Experiment reference number; Target: target gene; [oligo]: concentration of oligonucleotide used in nM unless otherwise indicated; Cell Line: cell line used; Assay Type: assay used; Time (hr): time of assay following treatment; $2^{nd}$ Drug: name of second oligonucleotide (identified by Oligo Name) or drug used in combination experiment; $[2^{nd}]$: concentration of second oligonucleotide or drug; Units: units of concentration; $3^{rd}$ Drug: name of third oligonucleotide (identified by Oligo Name) or drug used in combination experiment; $[3^{rd}]$: concentration of third oligonucleotide or drug; Notes: comments regarding experiment. Oligo Names correspond to those in Tables 2 and 4.

DETAILED DESCRIPTION OF CERTAIN EMBODIMENTS OF THE INVENTION

Spinal muscular atrophy (SMA), the most common genetic cause of infant mortality, is an autosomal recessive neuromuscular disease characterized by progressive loss of α-motor neurons in the anterior horns of the spinal cord, leading to limb and trunk paralysis and atrophy of voluntary muscles. Based on the severity and age of onset, SMA is clinically subdivided into types I, II, and III (MIMs 253300, 253550, and 253400), with type I generally understood as being the most severe.

Loss of function of the SMN1 gene is responsible for SMA. Humans have an extra SMN gene copy, called SMN2. Both SMN genes reside within a segmental duplication on Chromosome 5q13 as inverted repeats. SMN1 and SMN2 are almost identical. In some cases, SMN1 and SMN2 differ by 11 nucleotide substitutions, including seven in intron 6, two in intron 7, one in coding exon 7, and one in non-coding exon 8. The substitution in exon 7 involves a translationally silent C to T transition compared with SMN1, that results in alternative splicing because the substitution disrupts recognition of the upstream 3' splice site, in which exon 7 is frequently skipped during precursor mRNA splicing. Consequently, SMN2 encodes primarily the exon 7-skipped protein isoform (SMNΔ7), which is unstable, mislocalized, and only partially functional.

Methods and related single stranded oligonucleotides that are useful for selectively inducing expression of particular splice variants of SMN1 or SMN2 are provided herein. The methods are useful for controlling the levels in a cell of particular SMN protein isoforms encoded by the splice variants. In some cases, the methods are useful for inducing expression of SMN proteins to levels sufficient to treat SMA. For example, according to some aspects of the invention methods are provided for increasing expression of full-length SMN protein in a cell for purposes of treating SMA. In some embodiments, the methods comprise delivering to the cell a first single stranded oligonucleotide complementary with a PRC2-associated region of SMN1 or SMN2 and a second single stranded oligonucleotide complementary with a splice control sequence of a precursor mRNA of SMN1 or SMN2, in amounts sufficient to increase expression of a mature mRNA of SMN1 or SMN2 that comprises (or includes) exon 7 in the cell. Further aspects of the invention are described in detailed herein.

Polycomb Repressive Complex 2 (PRC2)-Interacting RNAs

Aspects of the invention provided herein relate to the discovery of polycomb repressive complex 2 (PRC2)-interacting RNAs. Polycomb repressive complex 2 (PRC2) is a histone methyltransferase and a known epigenetic regulator involved in silencing of genomic regions through methylation of histone H3. Among other functions, PRC2 interacts with long noncoding RNAs (lncRNAs), such as RepA, Xist, and Tsix, to catalyze trimethylation of histone H3-lysine27. PRC2 contains four subunits, Eed, Suz12, RbAp48, and Ezh2. Aspects of the invention relate to the recognition that single stranded oligonucleotides that bind to PRC2-associated regions of RNAs (e.g., lncRNAs) that are expressed from within a genomic region that encompasses or that is in functional proximity to the SMN1 or SMN2 gene can induce or enhance expression of SMN1 or SMN2. In some embodiments, this upregulation is believed to result from inhibition of PRC2 mediated repression of SMN1 or SMN2.

As used herein, the term "PRC2-associated region" refers to a region of a nucleic acid that comprises or encodes a sequence of nucleotides that interact directly or indirectly with a component of PRC2. A PRC2-associated region may be present in a RNA (e.g., a long non-coding RNA (lncRNA)) that interacts with a PRC2. A PRC2-associated region may be present in a DNA that encodes an RNA that interacts with PRC2. In some cases, the PRC2-associated region is equivalently referred to as a PRC2-interacting region.

In some embodiments, a PRC2-associated region is a region of an RNA that crosslinks to a component of PRC2 in response to in situ ultraviolet irradiation of a cell that expresses the RNA, or a region of genomic DNA that encodes that RNA region. In some embodiments, a PRC2-associated region is a region of an RNA that immunoprecipitates with an antibody that targets a component of PRC2, or a region of genomic DNA that encodes that RNA region. In some embodiments, a PRC2-associated region is a region of an RNA that immunoprecipitates with an antibody that binds specifically to SUZ12, EED, EZH2 or RBBP4 (which as noted above are components of PRC2), or a region of genomic DNA that encodes that RNA region.

In some embodiments, a PRC2-associated region is a region of an RNA that is protected from nucleases (e.g., RNases) in an RNA-immunoprecipitation assay that employs an antibody that targets a component of PRC2, or a region of genomic DNA that encodes that protected RNA region. In some embodiments, a PRC2-associated region is a region of an RNA that is protected from nucleases (e.g., RNases) in an RNA-immunoprecipitation assay that employs an antibody that targets SUZ12, EED, EZH2 or RBBP4, or a region of genomic DNA that encodes that protected RNA region.

In some embodiments, a PRC2-associated region is a region of an RNA within which occur a relatively high frequency of sequence reads in a sequencing reaction of products of an RNA-immunoprecipitation assay that employs an antibody that targets a component of PRC2, or a region of genomic DNA that encodes that RNA region. In some embodiments, a PRC2-associated region is a region of an RNA within which occur a relatively high frequency of sequence reads in a sequencing reaction of products of an RNA-immunoprecipitation assay that employs an antibody that binds specifically to SUZ12, EED, EZH2 or RBBP4, or a region of genomic DNA that encodes that protected RNA region. In such embodiments, the PRC2-associated region may be referred to as a "peak."

In some embodiments, a PRC2-associated region comprises a sequence of 40 to 60 nucleotides that interact with PRC2 complex. In some embodiments, a PRC2-associated region comprises a sequence of 40 to 60 nucleotides that encode an RNA that interacts with PRC2. In some embodiments, a PRC2-associated region comprises a sequence of up to 5 kb in length that comprises a sequence (e.g., of 40 to 60 nucleotides) that interacts with PRC2. In some embodiments, a PRC2-associated region comprises a sequence of up to 5 kb in length within which an RNA is encoded that has a sequence (e.g., of 40 to 60 nucleotides) that is known to interact with PRC2. In some embodiments, a PRC2-associated region comprises a sequence of about 4 kb in length that comprise a sequence (e.g., of 40 to 60 nucleotides) that interacts with PRC2. In some embodiments, a PRC2-associated region comprises a sequence of about 4 kb in length within which an RNA is encoded that includes a sequence (e.g., of 40 to 60 nucleotides) that is known to interact with PRC2. In some embodiments, a PRC2-associated region has a sequence as set forth in any one of SEQ ID NOS: 9 to 29. In some embodiments, a PRC2-associated region has a sequence as set forth in any one of SEQ ID NOS: 24 to 29.

In some embodiments, single stranded oligonucleotides are provided that specifically bind to, or are complementary to, a PRC2-associated region in a genomic region that encompasses or that is in proximity to the SMN1 or SMN2 gene. In some embodiments, single stranded oligonucleotides are provided that specifically bind to, or are complementary to, a PRC2-associated region that has a sequence as set forth in any one of SEQ ID NOS: 9 to 29. In some embodiments, single stranded oligonucleotides are provided that specifically bind to, or are complementary to, a PRC2-associated region that has a sequence as set forth in any one of SEQ ID NOS: 9 to 29 combined with up to 2 kb, up to 5 kb, or up to 10 kb of flanking sequences from a corresponding genomic region to which these SEQ IDs map (e.g., in a human genome). In some embodiments, single stranded oligonucleotides have a sequence as set forth in any one of SEQ ID NOS: 30 to 13087. In some embodiments, single stranded oligonucleotides have a sequence as set forth in Table 2. In some embodiments, a PRC2 associated region of SMN1 or SMN2 against which a single stranded oligonucleotide is complementary is selected from SEQ ID NOS: 24-29. In some embodiments, a single stranded oligonucleotide that is complementary with a PRC2 associated region of SMN1 or SMN2 comprises a sequence selected from SEQ ID NOS: 1158-1159, 1171, 1482-1483, 1485-1486, 2465-2471, 2488-2490, 2542-2546, 2656-2657, 2833-2835, 3439-3440, 3916-3918, 4469-4472, 4821, 5429, 5537, 6061, 7327, 8330-13061, and 13062-13087. In some embodiments, a single stranded oligonucleotide that is complementary with a PRC2 associated region of SMN1 or SMN2 comprises a sequence selected from 11395, 11394, 10169, and 10170.

Without being bound by a theory of invention, these oligonucleotides are able to interfere with the binding of and function of PRC2, by preventing recruitment of PRC2 to a specific chromosomal locus. For example, a single administration of single stranded oligonucleotides designed to specifically bind a PRC2-associated region lncRNA can stably displace not only the lncRNA, but also the PRC2 that binds to the lncRNA, from binding chromatin. After displacement, the full complement of PRC2 is not recovered for up to 24 hours. Further, lncRNA can recruit PRC2 in a cis fashion, repressing gene expression at or near the specific chromosomal locus from which the lncRNA was transcribed.

Methods of modulating gene expression are provided, in some embodiments, that may be carried out in vitro, ex vivo, or in vivo. It is understood that any reference to uses of compounds throughout the description contemplates use of the compound in preparation of a pharmaceutical composition or medicament for use in the treatment of condition (e.g., Spinal muscular atrophy) associated with decreased levels or activity of SMN1 or SMN2. Thus, as one nonlimiting example, this aspect of the invention includes use of such single stranded oligonucleotides in the preparation of a medicament for use in the treatment of disease, wherein the treatment involves upregulating expression of SMN1 or SMN2.

In further aspects of the invention, methods are provided for selecting a candidate oligonucleotide for activating expression of SMN1 or SMN2. The methods generally involve selecting as a candidate oligonucleotide, a single stranded oligonucleotide comprising a nucleotide sequence that is complementary to a PRC2-associated region (e.g., a nucleotide sequence as set forth in any one of SEQ ID NOS: 9 to 29). In some embodiments, sets of oligonucleotides may be selected that are enriched (e.g., compared with a random selection of oligonucleotides) in oligonucleotides that activate expression of SMN1 or SMN2.

Single Stranded Oligonucleotides for Modulating Expression of SMN1 or SMN2

In one aspect of the invention, single stranded oligonucleotides complementary to the PRC2-associated regions are provided for modulating expression of SMN1 or SMN2 in a cell. In some embodiments, expression of SMN1 or SMN2 is upregulated or increased. In some embodiments, single stranded oligonucleotides complementary to these PRC2-associated regions inhibit the interaction of PRC2 with long RNA transcripts such that gene expression is upregulated or increased. In some embodiments, single stranded oligonucleotides complementary to these PRC2-associated regions inhibit the interaction of PRC2 with long RNA transcripts, resulting in reduced methylation of histone H3 and reduced gene inactivation, such that gene expression is upregulated or increased. In some embodiments, this interaction may be disrupted or inhibited due to a change in the structure of the long RNA that prevents or reduces binding to PRC2. The oligonucleotide may be selected using any of the methods disclosed herein for selecting a candidate oligonucleotide for activating expression of SMN1 or SMN2.

The single stranded oligonucleotide may comprise a region of complementarity that is complementary with a PRC2-associated region of a nucleotide sequence set forth in any one of SEQ ID NOS: 1 to 8. The region of complementarity of the single stranded oligonucleotide may be complementary with at least 6, e.g., at least 7, at least 8, at least 9, at least 10, at least 15 or more consecutive nucleotides of the PRC2-associated region.

It should be appreciated that due the high homology between SMN1 and SMN2, single stranded oligonucleotides that are complementary with a PRC2-associated region of SMN1 are often also complementary with a corresponding PRC2-associated region of SMN2.

The PRC2-associated region may map to a position in a chromosome between 50 kilobases upstream of a 5'-end of the SMN1 or SMN2 gene and 50 kilobases downstream of a 3'-end of the SMN1 or SMN2 gene. The PRC2-associated region may map to a position in a chromosome between 25 kilobases upstream of a 5'-end of the SMN1 or SMN2 gene and 25 kilobases downstream of a 3'-end of the SMN1 or SMN2 gene. The PRC2-associated region may map to a position in a chromosome between 12 kilobases upstream of a 5'-end of the SMN1 or SMN2 gene and 12 kilobases downstream of a 3'-end of the SMN1 or SMN2 gene. The PRC2-associated region may map to a position in a chromosome between 5 kilobases upstream of a 5'-end of the SMN1 or SMN2 gene and 5 kilobases downstream of a 3'-end of the SMN1 or SMN2 gene.

The genomic position of the selected PRC2-associated region relative to the SMN1 or SMN2 gene may vary. For example, the PRC2-associated region may be upstream of the 5' end of the SMN1 or SMN2 gene. The PRC2-associated region may be downstream of the 3' end of the SMN1 or SMN2 gene. The PRC2-associated region may be within an intron of the SMN1 or SMN2 gene. The PRC2-associated region may be within an exon of the SMN1 or SMN2 gene. The PRC2-associated region may traverse an intron-exon junction, a 5'-UTR-exon junction or a 3'-UTR-exon junction of the SMN1 or SMN2 gene.

The single stranded oligonucleotide may comprise a sequence having the formula X-Y-Z, in which X is any nucleotide, Y is a nucleotide sequence of 6 nucleotides in length that is not a human seed sequence of a microRNA, and Z is a nucleotide sequence of varying length. In some embodiments X is the 5' nucleotide of the oligonucleotide. In some embodiments, when X is anchored at the 5' end of the oligonucleotide, the oligonucleotide does not have any nucleotides or nucleotide analogs linked 5' to X. In some embodiments, other compounds such as peptides or sterols may be linked at the 5' end in this embodiment as long as they are not nucleotides or nucleotide analogs. In some embodiments, the single stranded oligonucleotide has a sequence 5'X-Y-Z and is 8-50 nucleotides in length. Oligonucleotides that have these sequence characteristics are predicted to avoid the miRNA pathway. Therefore, in some embodiments, oligonucleotides having these sequence characteristics are unlikely to have an unintended consequence of functioning in a cell as a miRNA molecule. The Y sequence may be a nucleotide sequence of 6 nucleotides in length set forth in Table 1.

The single stranded oligonucleotide may have a sequence that does not contain guanosine nucleotide stretches (e.g., 3 or more, 4 or more, 5 or more, 6 or more consecutive guanosine nucleotides). In some embodiments, oligonucleotides having guanosine nucleotide stretches have increased non-specific binding and/or off-target effects, compared with oligonucleotides that do not have guanosine nucleotide stretches.

The single stranded oligonucleotide may have a sequence that has less than a threshold level of sequence identity with every sequence of nucleotides, of equivalent length, that map to a genomic position encompassing or in proximity to an off-target gene. For example, an oligonucleotide may be designed to ensure that it does not have a sequence that maps to genomic positions encompassing or in proximity with all known genes (e.g., all known protein coding genes) other than SMN1 or SMN2. In a similar embodiment, an oligonucleotide may be designed to ensure that it does not have a sequence that maps to any other known PRC2-associated region, particularly PRC2-associated regions that are functionally related to any other known gene (e.g., any other known protein coding gene). In either case, the oligonucleotide is expected to have a reduced likelihood of having off-target effects. The threshold level of sequence identity may be 50%, 60%, 70%, 80%, 85%, 90%, 95%, 99% or 100% sequence identity.

The single stranded oligonucleotide may have a sequence that is complementary to a PRC2-associated region that encodes an RNA that forms a secondary structure comprising at least two single stranded loops. In has been discovered that, in some embodiments, oligonucleotides that are complementary to a PRC2-associated region that encodes an RNA that forms a secondary structure comprising one or more single stranded loops (e.g., at least two single stranded loops) have a greater likelihood of being active (e.g., of being capable of activating or enhancing expression of a target gene) than a randomly selected oligonucleotide. In some cases, the secondary structure may comprise a double stranded stem between the at least two single stranded loops. Accordingly, the region of complementarity between the oligonucleotide and the PRC2-associated region may be at a location of the PRC2 associated region that encodes at least a portion of at least one of the loops. In some cases, the region of complementarity between the oligonucleotide and the PRC2-associated region may be at a location of the PRC2-associated region that encodes at least a portion of at least two of the loops. In some cases, the region of complementarity between the oligonucleotide and the PRC2-associated region may be at a location of the PRC2 associated region that encodes at least a portion of the double stranded stem. In some embodiments, a PRC2-associated region (e.g., of an lncRNA) is identified (e.g., using RIP-Seq methodology or information derived therefrom). In some embodiments, the predicted secondary structure RNA (e.g., lncRNA) containing the PRC2-associated region is determined using RNA secondary structure prediction algorithms, e.g., RNAfold, mfold. In some embodiments, oligonucleotides are designed to target a region of the RNA that forms a secondary structure comprising one or more single stranded loop (e.g., at least two single stranded loops) structures which may comprise a double stranded stem between the at least two single stranded loops.

The single stranded oligonucleotide may have a sequence that is has greater than 30% G-C content, greater than 40% G-C content, greater than 50% G-C content, greater than 60% G-C content, greater than 70% G-C content, or greater than 80% G-C content. The single stranded oligonucleotide may have a sequence that has up to 100% G-C content, up to 95% G-C content, up to 90% G-C content, or up to 80% G-C content. In some embodiments in which the oligonucleotide is 8 to 10 nucleotides in length, all but 1, 2, 3, 4, or 5 of the nucleotides of the complementary sequence of the PRC2-associated region are cytosine or guanosine nucleotides. In some embodiments, the sequence of the PRC2-associated region to which the single stranded oligonucleotide is complementary comprises no more than 3 nucleotides selected from adenine and uracil.

The single stranded oligonucleotide may be complementary to a chromosome of a different species (e.g., a mouse, rat, rabbit, goat, monkey, etc.) at a position that encompasses or that is in proximity to that species' homolog of SMN1 or SMN2. The single stranded oligonucleotide may be complementary to a human genomic region encompassing or in proximity to the SMN1 or SMN2 gene and also be complementary to a mouse genomic region encompassing or in proximity to the mouse homolog of SMN1 or SMN2. For example, the single stranded oligonucleotide may be complementary to a sequence as set forth in SEQ ID NO: 1, 2, 4, or 5, which is a human genomic region encompassing or in proximity to the SMN1 or SMN2 gene, and also be complementary to a sequence as set forth in SEQ ID NO:7 or 8, which is a mouse genomic region encompassing or in proximity to the mouse homolog of the SMN1 or SMN2 gene. Oligonucleotides having these characteristics may be tested in vivo or in vitro for efficacy in multiple species (e.g., human and mouse). This approach also facilitates development of clinical candidates for treating human disease by selecting a species in which an appropriate animal exists for the disease.

In some embodiments, the region of complementarity of the single stranded oligonucleotide is complementary with at least 8 to 15, 8 to 30, 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of a PRC2-associated region. In some embodiments, the region of complementarity is complementary with at least 8 consecutive nucleotides of a PRC2-associated region. In some embodiments the sequence of the single stranded oligonucleotide is based on an RNA sequence that binds to PRC2, or a portion thereof, said portion having a length of from 5 to 40 contiguous base pairs, or about 8 to 40 bases, or about 5 to 15, or about 5 to 30, or about 5 to 40 bases, or about 5 to 50 bases. Complementary, as the term is used in the art, refers to the capacity for precise pairing between two nucleotides. For example, if a nucleotide at a certain position of an oligonucleotide is capable of hydrogen bonding with a nucleotide at the same position of PRC2-associated region, then the single stranded nucleotide and PRC2-associated region are considered to be complementary to each other at that position. The single stranded nucleotide and PRC2-associated region are complementary to each other when a sufficient number of corresponding positions in each molecule are occupied by nucleotides that can hydrogen bond with each other through their bases. Thus, "complementary" is a term which is used to indicate a sufficient degree of complementarity or precise pairing such that stable and specific binding occurs between the single stranded nucleotide and PRC2-associated region. For example, if a base at one position of a single stranded nucleotide is capable of hydrogen bonding with a base at the corresponding position of a PRC2-associated region, then the bases are considered to be complementary to each other at that position. 100% complementarity is not required.

The single stranded oligonucleotide may be at least 80% complementary to (optionally one of at least 85%, 90%, 91%, 92%, 93%, 94%, 95%, 96%, 97%, 98%, 99% or 100% complementary to) the consecutive nucleotides of a PRC2-associated region. In some embodiments the single stranded oligonucleotide may contain 1, 2 or 3 base mismatches compared to the portion of the consecutive nucleotides of a PRC2-associated region. In some embodiments the single stranded oligonucleotide may have up to 3 mismatches over 15 bases, or up to 2 mismatches over 10 bases.

It is understood in the art that a complementary nucleotide sequence need not be 100% complementary to that of its target to be specifically hybridizable. In some embodiments, a complementary nucleic acid sequence for purposes of the present disclosure is specifically hybridizable when binding of the sequence to the target molecule (e.g., lncRNA) interferes with the normal function of the target (e.g., lncRNA) to cause a loss of activity (e g, inhibiting PRC2-associated repression with consequent up-regulation of gene expression) and there is a sufficient degree of complementarity to avoid non-specific binding of the sequence to non-target sequences under conditions in which avoidance of non-specific binding is desired, e.g., under physiological conditions in the case of in vivo assays or therapeutic treatment, and in the case of in vitro assays, under conditions in which the assays are performed under suitable conditions of stringency.

In some embodiments, the single stranded oligonucleotide is 7, 8, 9, 10, 11, 12, 13, 14, 15, 16, 17, 18, 19, 20, 21, 22, 23, 24, 25, 26, 27, 28, 29, 30, 35, 40, 45, 50 or more nucleotides in length. In a preferred embodiment, the oligonucleotide is 8 to 30 nucleotides in length.

In some embodiments, the PRC2-associated region occurs on the same DNA strand as a gene sequence (sense). In some embodiments, the PRC2-associated region occurs on the opposite DNA strand as a gene sequence (anti-sense). Oligonucleotides complementary to a PRC2-associated region can bind either sense or anti-sense sequences. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Inosine (I) has also been considered in the art to be a universal base and is considered complementary to any A, C, U or T.

In some embodiments, any one or more thymidine (T) nucleotides (or modified nucleotide thereof) or uridine (U) nucleotides (or a modified nucleotide thereof) in a sequence provided herein, including a sequence provided in the sequence listing, may be replaced with any other nucleotide suitable for base pairing (e.g., via a Watson-Crick base pair) with an adenosine nucleotide. In some embodiments, any one or more thymidine (T) nucleotides (or modified nucleotide thereof) or uridine (U) nucleotides (or a modified nucleotide thereof) in a sequence provided herein, including a sequence provided in the sequence listing, may be suitably replaced with a different pyrimidine nucleotide or vice versa. In some embodiments, any one or more thymidine (T) nucleotides (or modified nucleotide thereof) in a sequence provided herein, including a sequence provided in the sequence listing, may be suitably replaced with a uridine (U) nucleotide (or a modified nucleotide thereof) or vice versa. In some embodiments, GC content of the single stranded oligonucleotide is preferably between about 30-60%. Contiguous runs of three or more Gs or Cs may not be preferable in some embodiments. Accordingly, in some embodiments, the oligonucleotide does not comprise a stretch of three or more guanosine nucleotides.

In some embodiments, the single stranded oligonucleotide specifically binds to, or is complementary to an RNA that is encoded in a genome (e.g., a human genome) as a single contiguous transcript (e.g., a non-spliced RNA). In some embodiments, the single stranded oligonucleotide specifically binds to, or is complementary to an RNA that is encoded in a genome (e.g., a human genome), in which the distance in the genome between the 5' end of the coding region of the RNA and the 3' end of the coding region of the RNA is less than 1 kb, less than 2 kb, less than 3 kb, less than 4 kb, less than 5 kb, less than 7 kb, less than 8 kb, less than 9 kb, less than 10 kb, or less than 20 kb.

It is to be understood that any oligonucleotide provided herein can be excluded.

In some embodiments, single stranded oligonucleotides disclosed herein may increase expression of mRNA corresponding to the gene by at least about 50% (i.e. 150% of normal or 1.5 fold), or by about 2 fold to about 5 fold. In some embodiments, expression may be increased by at least about 15 fold, 20 fold, 30 fold, 40 fold, 50 fold or 100 fold, or any range between any of the foregoing numbers. It has also been found that increased mRNA expression has been shown to correlate to increased protein expression.

In some or any of the embodiments of the oligonucleotides described herein, or processes for designing or synthesizing them, the oligonucleotides will upregulate gene expression and may specifically bind or specifically hybridize or be complementary to the PRC2 binding RNA that is transcribed from the same strand as a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding sense strand of a reference gene (refGene).

In some or any of the embodiments of oligonucleotides described herein, or processes for designing or synthesizing them, the oligonucleotides will upregulate gene expression and may specifically bind or specifically hybridize or be complementary to a PRC2 binding RNA that transcribed from the opposite strand (the antisense strand) of a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding antisense strand of a reference gene.

The oligonucleotides described herein may be modified, e.g., comprise a modified sugar moiety, a modified internucleoside linkage, a modified nucleotide and/or combinations thereof. In addition, the oligonucleotides can exhibit one or more of the following properties: do not induce substantial cleavage or degradation of the target RNA; do not cause substantially complete cleavage or degradation of the target RNA; do not activate the RNAse H pathway; do not activate RISC; do not recruit any Argonaute family protein; are not cleaved by Dicer; do not mediate alternative splicing; are not immune stimulatory; are nuclease resistant; have improved cell uptake compared to unmodified oligonucleotides; are not toxic to cells or mammals; may have improved endosomal exit; do interfere with interaction of lncRNA with PRC2, preferably the Ezh2 subunit but optionally the Suz12, Eed, RbAp46/48 subunits or accessory factors such as Jarid2; do decrease histone H3 lysine27 methylation and/or do upregulate gene expression.

Oligonucleotides that are designed to interact with RNA to modulate gene expression are a distinct subset of base sequences from those that are designed to bind a DNA target (e.g., are complementary to the underlying genomic DNA sequence from which the RNA is transcribed).

Splice Switching Oligonucleotides

Aspects of the invention provide strategies for targeting SMN1 or SMN2 precursor mRNA to affect splicing to minimize exon skipping. Accordingly, aspects of the invention provide therapeutic compounds useful for the treatment of SMA. In some embodiments, oligonucleotides, referred to herein as "splice switching oligonucleotides" are provided that modulate SMN2 splicing. Methods and related compositions, compounds, and kits are provided, in some embodiments, that are useful for increasing expression of full-length. SMN protein in a cell. The methods generally involve delivering to a cell a first single stranded oligonucleotide complementary with at least 8 consecutive nucleotides of a PRC2-associated region of SMN2 and a second single stranded oligonucleotide complementary with a splice control sequence of a precursor mRNA of SMN2, in amounts sufficient to increase expression of a mature mRNA of SMN2 that comprises (or includes) exon 7 in the cell. Any of the single stranded oligonucleotides that are complementary with at least 8 consecutive nucleotides of a PRC2-associated region of SMN1 or SMN2 may be used. It should be appreciated that single stranded oligonucleotides that are complementary with a splice control sequence may alternatively be referred herein, as splice switching oligonucleotides.

Splice switching oligonucleotides typically comprise a sequence complementary to a splice control sequence (e.g., a intronic splicing silencer sequence) of a precursor mRNA, and are capable of binding to and affecting processing of the precursor mRNA. Splice switching oligonucleotides may be complementary with a region of an exon, a region of an intron or an intron/exon junction. In some embodiments, the splice control sequence comprises the sequence: CAG-CAUUAUGAAAG (SEQ ID NO: 13100) or a portion thereof. In some embodiments, the splice control sequence comprises at least one hnRNAP binding sequence. In some embodiments, splice switching oligonucleotides that target SMN1 or SMN2 function based on the premise that there is a competition between the 3' splice sites of exons 7 and 8 for pairing with the 5' splice site of exon 6, so impairing the recognition of the 3' splice site of exon 8 favors exon 7 inclusion. In some embodiments, splice switching oligonucleotides are provided that promote SMN2 exon 7 inclusion and full-length SMN protein expression, in which the oligonucleotides are complementary to the intron 7/exon 8 junction. In some embodiments, splice switching oligonucleotide are composed of a segment complementary to an exon of SMN1 or SMN2 (e.g., exon 7). In some embodiments, splice switching oligonucleotides comprise a tail (e.g., a non-complementary tail) consisting of RNA sequences with binding motifs recognized by a serine/arginine-rich (SR) protein. In some embodiments, splice switching oligonucleotides are complementary (at least partially) with an intronic splicing silencer (ISS). In some embodiments, the ISS is in intron 6 or intron 7 of SMN1 or SMN2. In some embodiments, splice switching oligonucleotides comprise an antisense moiety complementary to a target exon or intron (e.g., of SMN1 or SMN2) and a minimal RS domain peptide similar to the splicing activation domain of SR proteins. In some embodiments, the splice switching oligonucleotide is 7, 8, 9, 10, 11, 12, 13, 14, 15, 16, 17, 18, 19, 20, 21, 22, 23, 24, 25, 26, 27, 28, 29, 30, 35, 40, 45, 50 or more nucleotides in length. In one embodiment, the oligonucleotide is 8 to 30 nucleotides in length.

Linkers

Any of the oligonucleotides disclosed herein may be linked to one or more other oligonucleotides disclosed herein by a linker, e.g., a cleavable linker. Accordingly, in some embodiments, compounds are provided that comprise a single stranded oligonucleotide complementary with a PRC2-associated region of a gene that is linked via a linker to a single stranded oligonucleotide complementary to a splice control sequence of a precursor mRNA of the gene. In some embodiments, compounds are provided that have the general formula A-B-C, in which A is a single stranded oligonucleotide complementary with a PRC2-associated region of a gene, B is a linker, and C is a single stranded oligonucleotide complementary to a splice control sequence of a precursor mRNA of the gene. In some embodiments, linker B comprises an oligonucleotide, peptide, low pH labile bond, or disulfide bond. In some embodiments, the compounds is orientated as 5'-A-B-C-3'. In some embodiments, the compound is orientated as 3'-A-B-C-5'. In some embodiments, where B is an oligonucleotide, the 3' end of A is linked to the 5' end of B, and the 3' end of B is linked to 5' end of C. In some embodiments, where B is an oligonucleotide, the 5' end of A is linked to the 3' end of B, and the 5' end of B is linked to 3' end of C. In some embodiments, where B is an oligonucleotide, the 5' end of A is linked to the 5' end of B, and/or the 3' end of B is linked to the 3' end of C. In some embodiments, where B is an oligonucleotide, the 3' end of A is linked to the 3' end of B, and/or the 5' end of B is linked to the 5' end of C.

The term "linker" generally refers to a chemical moiety that is capable of covalently linking two or more oligonucleotides. In some embodiments, at least one bond comprised or contained within the linker is capable of being cleaved (e.g., in a biological context, such as in a mammalian extract, such as an endosomal extract), such that at least two oligonucleotides are no longer covalently linked to one another after bond cleavage. It will be appreciated that, in some embodiments, a provided linker may include a region that is non-cleavable, as long as the linker also comprises at least one bond that is cleavable.

In some embodiments, the linker comprises a polypeptide that is more susceptible to cleavage by an endopeptidase in the mammalian extract than the oligonucleotides. The endopeptidase may be a trypsin, chymotrypsin, elastase, thermolysin, pepsin, or endopeptidase V8. The endopeptidase may be a cathepsin B, cathepsin D, cathepsin L, cathepsin C, papain, cathepsin S or endosomal acidic insulinase. For example, the linker comprise a peptide having an amino acid sequence selected from: ALAL, APISFFELG, FL, GFN, R/KXX, GRWHTVGLRWE, YL, GF, and FF, in which X is any amino acid.

In some embodiments, the linker comprises the formula $-(CH_2)_nS-S(CH_2)_m-$, wherein n and m are independently integers from 0 to 10.

In some embodiments, the linker may comprise an oligonucleotide that is more susceptible to cleavage by an endonuclease in the mammalian extract than the oligonucleotides. The linker may have a nucleotide sequence comprising from 1 to 10 thymidines or uridines. The linker may have a nucleotide sequence comprising deoxyribonucleotides linked through phosphodiester internucleotide linkages. The linker may have a nucleotide sequence comprising from 1 to 10 thymidines or uridines linked through phosphodiester internucleotide linkages. The linker may have a nucleotide sequence comprising from 1 to 10 thymidines or uridines linked through phosphorothioate internucleotide linkages.

In some embodiments, at least one linker is 2-fold, 3-fold, 4-fold, 5-fold, 10-fold or more sensitive to enzymatic cleavage in the presence of a mammalian extract than at least two oligonucleotides. It should be appreciated that different linkers can be designed to be cleaved at different rates and/or by different enzymes in compounds comprising two or more linkers. Similarly different linkers can be designed to be sensitive to cleavage in different tissues, cells or subcellular compartments in compounds comprising two or more linkers. This can advantageously permit compounds to have oligonucleotides that are released from compounds at different rates, by different enzymes, or in different tissues, cells or subcellular compartments thereby controlling release of the monomeric oligonucleotides to a desired in vivo location or at a desired time following administration.

In certain embodiments, linkers are stable (e.g., more stable than the oligonucleotides they link together) in plasma, blood or serum which are richer in exonucleases, and less stable in the intracellular environments which are relatively rich in endonucleases. In some embodiments, a linker is considered "non-cleavable" if the linker's half-life is at least 24, or 28, 32, 36, 48, 72, 96 hours or longer under the conditions described here, such as in liver homogenates. Conversely, in some embodiments, a linker is considered "cleavable" if the half-life of the linker is at most 10, or 8, 6, 5 hours or shorter.

In some embodiments, the linker is a nuclease-cleavable oligonucleotide linker. In some embodiments, the nuclease-cleavable linker contains one or more phosphodiester bonds in the oligonucleotide backbone. For example, the linker may contain a single phosphodiester bridge or 2, 3, 4, 5, 6, 7 or more phosphodiester linkages, for example as a string of 1-10 deoxynucleotides, e.g., dT, or ribonucleotides, e.g., rU, in the case of RNA linkers. In the case of dT or other DNA nucleotides dN in the linker, in certain embodiments the cleavable linker contains one or more phosphodiester linkages. In other embodiments, in the case of rU or other RNA nucleotides rN, the cleavable linker may consist of phosphorothioate linkages only. In contrast to phosphorothioate-linked deoxynucleotides, which in some embodiments are cleaved relatively slowly by nucleases (thus termed "noncleavable"), phosphorothioate-linked rU undergoes relatively rapid cleavage by ribonucleases and therefore is considered cleavable herein in some embodiments. It is also possible to combine dN and rN into the linker region, which are connected by phosphodiester or phosphorothioate linkages. In other embodiments, the linker can also contain chemically modified nucleotides, which are still cleavable by nucleases, such as, e.g., 2'-O-modified analogs. In particular, 2'-O-methyl or 2'-fluoro nucleotides can be combined with each other or with dN or rN nucleotides. Generally, in the case of nucleotide linkers, the linker is a part of the compound that is usually not complementary to a target, although it could be. This is because the linker is generally cleaved prior to action of the oligonucleotides on the target, and therefore, the linker identity with respect to a target is inconsequential. Accordingly, in some embodiments, a linker is an (oligo)nucleotide linker that is not complementary to any of the targets against which the oligonucleotides are designed.

In some embodiments, the cleavable linker is an oligonucleotide linker that contains a continuous stretch of deliberately introduced Rp phosphorothioate stereoisomers (e.g., 4, 5, 6, 7 or longer stretches). The Rp stereoisoform, unlike Sp isoform, is known to be susceptible to nuclease cleavage (Krieg et al., 2003, Oligonucleotides, 13:491-499). Such a linker would not include a racemic mix of PS linkaged oligonucleotides since the mixed linkages are relatively stable and are not likely to contain long stretches of the Rp stereoisomers, and therefore, considered "non-cleavable" herein. Thus, in some embodiments, a linker comprises a stretch of 4, 5, 6, 7 or more phosphorothioated nucleotides, wherein the stretch does not contain a substantial amount or any of the Sp stereoisoform. The amount could be considered substantial if it exceeds 10% on a per-mole basis.

In some embodiments, the linker is a non-nucleotide linker, for example, a single phosphodiester bridge. Another example of such cleavable linkers is a chemical group comprising a disulfide bond, for example, —$(CH_2)_n$S—S$(CH_2)_m$—, wherein n and m are integers from 0 to 10. In illustrative embodiments, n=m=6. Additional examples of non-nucleotide linkers are described below.

The linker can be designed so as to undergo a chemical or enzymatic cleavage reaction. Chemical reactions involve, for example, cleavage in acidic environments (e.g., endosomes), reductive cleavage (e.g., cytosolic cleavage) or oxidative cleavage (e.g., in liver microsomes). The cleavage reaction can also be initiated by a rearrangement reaction. Enzymatic reactions can include reactions mediated by nucleases, peptidases, proteases, phosphatases, oxidases, reductases, etc. For example, a linker can be pH-sensitive, cathepsin-sensitive, or predominantly cleaved in endosomes and/or cytosol.

In some embodiments, the linker comprises a peptide. In certain embodiments, the linker comprises a peptide which includes a sequence that is cleavable by an endopeptidase. In addition to the cleavable peptide sequence, the linker may comprise additional amino acid residues and/or non-peptide chemical moieties, such as an alkyl chain. In certain embodiments, the linker comprises Ala-Leu-Ala-Leu, which is a substrate for cathepsin B. See, for example, the maleimidocaproyl-Arg-Arg-Ala-Leu-Ala-Leu linkers described in Schmid et al, Bioconjugate Chem 2007, 18, 702-716. In certain embodiments, a cathepsin B-cleavable linker is cleaved in tumor cells. In certain embodiments, the linker comprises Ala-Pro-Ile-Ser-Phe-Phe-Glu-Leu-Gly, which is a substrate for cathepsins D, L, and B (see, for example, Fischer et al, Chembiochem 2006, 7, 1428-1434). In certain embodiments, a cathepsin-cleavable linker is cleaved in HeLA cells. In some embodiments, the linker comprises Phe-Lys, which is a substrate for cathepsin B. For example, in certain embodiments, the linker comprises Phe-Lys-p-aminobenzoic acid (PABA). See, e.g., the maleimidocaproyl-Phe-Lys-PABA linker described in Walker et al, Bioorg. Med. Chem. Lett. 2002, 12, 217-219. In certain embodiments, the linker comprises Gly-Phe-2-naphthylamide, which is a substrate for cathepsin C (see, for example, Berg et al. Biochem. J. 1994, 300, 229-235). In certain embodiments, a cathepsin C-cleavable linker is cleaved in hepatocytes. In some embodiments, the linker comprises a cathepsin S cleavage site. For example, in some embodiments, the linker comprises Gly-Arg-Trp-His-Thr-Val-Gly-Leu-Arg-Trp-Glu, Gly-Arg-Trp-Pro-Pro-Met-Gly-Leu-Pro-Trp-Glu, or Gly-Arg-Trp-His-Pro-Met-Gly-Ala-Pro-Trp-Glu, for example, as described in Lutzner et al, J. Biol. Chem. 2008, 283, 36185-36194. In certain embodiments, a cathepsin S-cleavable linker is cleaved in antigen presenting cells. In some embodiments, the linker comprises a papain cleavage site. Papain typically cleaves a peptide having the sequence -R/K-X-X (see Chapman et al, Annu. Rev. Physiol 1997, 59, 63-88). In certain embodiments, a papain-cleavable linker is cleaved in endosomes. In some embodiments, the linker comprises an endosomal acidic insulinase cleavage site. For example, in some embodiments, the linker comprises Tyr-Leu, Gly-Phe, or Phe-Phe (see, e.g., Authier et al, FEBS Lett. 1996, 389, 55-60). In certain embodiments, an endosomal acidic insulinase-cleavable linker is cleaved in hepatic cells.

In some embodiments, the linker is pH sensitive. In certain embodiments, the linker comprises a low pH-labile bond. As used herein, a low-pH labile bond is a bond that is selectively broken under acidic conditions (pH<7). Such bonds may also be termed endosomally labile bonds, because cell endosomes and lysosomes have a pH less than 7. For example, in certain embodiments, the linker comprises an amine, an imine, an ester, a benzoic imine, an amino ester, a diortho ester, a polyphosphoester, a polyphosphazene, an acetal, a vinyl ether, a hydrazone, an azidomethyl-methylmaleic anhydride, a thiopropionate, a masked endosomolytic agent or a citraconyl group.

In certain embodiments, the linker comprises a low pH-labile bond selected from the following: ketals that are labile in acidic environments (e.g., pH less than 7, greater than about 4) to form a diol and a ketone; acetals that are labile in acidic environments (e.g., pH less than 7, greater than about 4) to form a diol and an aldehyde; imines or iminiums that are labile in acidic environments (e.g., pH less than 7, greater than about 4) to form an amine and an aldehyde or a ketone; silicon-oxygen-carbon linkages that are labile under acidic condition; silicon-nitrogen (silazane) linkages; silicon-carbon linkages (e.g., arylsilanes, vinylsilanes, and allylsilanes); maleamates (amide bonds synthesized from maleic anhydride derivatives and amines); ortho esters; hydrazones; activated carboxylic acid derivatives (e.g., esters, amides) designed to undergo acid catalyzed hydrolysis); or vinyl ethers. Further examples may be found in International Patent Appln. Pub. No. WO 2008/022309, entitled POLYCONJUGATES FOR IN VIVO DELIVERY OF POLYNUCLEOTIDES, the contents of which are incorporated herein by reference.

In some embodiments, the linker comprises a masked endosomolytic agent. Endosomolytic polymers are polymers that, in response to a change in pH, are able to cause disruption or lysis of an endosome or provide for escape of a normally membrane-impermeable compound, such as a polynucleotide or protein, from a cellular internal membrane-enclosed vesicle, such as an endosome or lysosome. A subset of endosomolytic compounds is fusogenic compounds, including fusogenic peptides. Fusogenic peptides can facilitate endosomal release of agents such as oligomeric compounds to the cytoplasm. See, for example, US Patent Application Publication Nos. 20040198687, 20080281041, 20080152661, and 20090023890, which are incorporated herein by reference.

The linker can also be designed to undergo an organ/tissue-specific cleavage. For example, for certain targets, which are expressed in multiple tissues, only the knockdown in liver may be desirable, as knock-down in other organs may lead to undesired side effects. Thus, linkers susceptible to liver-specific enzymes, such as pyrrolase (TPO) and glucose-6-phosphatase (G-6-Pase), can be engineered, so as to limit the antisense effect to the liver mainly. Alternatively, linkers not susceptible to liver enzymes but susceptible to kidney-specific enzymes, such as gamma-glutamyltranspeptidase, can be engineered, so that the antisense effect is limited to the kidneys mainly. Analogously, intestine-specific peptidases cleaving Phe-Ala and Leu-Ala could be considered for orally administered multimeric oligonucleotides. Similarly, by placing an enzyme recognition site into the linker, which is recognized by an enzyme over-expressed in tumors, such as plasmin (e.g., PHEA-D-Val-Leu-Lys recognition site), tumor-specific knock-down should be feasible. By selecting the right enzyme recognition site in the linker, specific cleavage and knock-down should be achievable in many organs. In addition, the linker can also contain a targeting signal, such as N-acetyl galactosamine for liver targeting, or folate, vitamin A or RGD-peptide in the case of tumor or activated macrophage targeting. Accordingly, in some embodiments, the cleavable linker is organ- or tissue-specific, for example, liver-specific, kidney-specific, intestine-specific, etc.

The oligonucleotides can be linked through any part of the individual oligonucleotide, e.g., via the phosphate, the sugar (e.g., ribose, deoxyribose), or the nucleobase. In certain embodiments, when linking two oligonucleotides together, the linker can be attached e.g. to the 5'-end of the first oligonucleotide and the 3'-end of the second nucleotide, to the 5'-end of the first oligonucleotide and the 5' end of the second nucleotide, to the 3'-end of the first oligonucleotide and the 3'-end of the second nucleotide. In other embodiments, when linking two oligonucleotides together, the linker can attach internal residues of each oligonucleotides, e.g., via a modified nucleobase. One of ordinary skill in the art will understand that many such permutations are available for multimers. Further examples of appropriate linkers as well as methods for producing compounds having such linkers are disclosed in International Patent Application Number, PCT/US2012/05535, entitled MULTIMERIC OLIGONUCLEOTIDE COMPOUNDS the contents of which relating to linkers and related chemistries are incorporated herein by referenced in its entirety.

Methods for Selecting Candidate Oligonucleotides for Activating Expression of SMN1 or SMN2

Methods are provided herein for selecting a candidate oligonucleotide for activating or enhancing expression of SMN1 or SMN2. The target selection methods may generally involve steps for selecting single stranded oligonucleotides having any of the structural and functional characteristics disclosed herein. Typically, the methods involve one or more steps aimed at identifying oligonucleotides that target a PRC2-associated region that is functionally related to SMN1 or SMN2, for example a PRC2-associated region of a lncRNA that regulates expression of SMN1 or SMN2 by facilitating (e.g., in a cis-regulatory manner) the recruitment of PRC2 to the SMN1 or SMN2 gene. Such oligonucleotides are expected to be candidates for activating expression of SMN1 or SMN2 because of their ability to hybridize with the PRC2-associated region of a nucleic acid (e.g., a lncRNA). In some embodiments, this hybridization event is understood to disrupt interaction of PRC2 with the nucleic acid (e.g., a lncRNA) and as a result disrupt recruitment of PRC2 and its associated co-repressors (e.g., chromatin remodeling factors) to the SMN1 or SMN2 gene locus.

Methods of selecting a candidate oligonucleotide may involve selecting a PRC2-associated region (e.g., a nucleotide sequence as set forth in any one of SEQ ID NOS: 9 to 29) that maps to a chromosomal position encompassing or in proximity to the SMN1 or SMN2 gene (e.g., a chromosomal position having a sequence as set forth in any one of SEQ ID NOS: 1 to 8). The PRC2-associated region may map to the strand of the chromosome comprising the sense strand of the SMN1 or SMN2 gene, in which case the candidate oligonucleotide is complementary to the sense strand of the SMN1 or SMN2 gene (i.e., is antisense to the SMN1 or SMN2 gene). Alternatively, the PRC2-associated region may map to the strand of the first chromosome comprising the antisense strand of the SMN1 or SMN2 gene, in which case the oligonucleotide is complementary to the antisense strand (the template strand) of the SMN1 or SMN2 gene (i.e., is sense to the SMN1 or SMN2 gene).

Methods for selecting a set of candidate oligonucleotides that is enriched in oligonucleotides that activate expression of SMN1 or SMN2 may involve selecting one or more PRC2-associated regions that map to a chromosomal position that encompasses or that is in proximity to the SMN1 or SMN2 gene and selecting a set of oligonucleotides, in which each oligonucleotide in the set comprises a nucleotide sequence that is complementary with the one or more PRC2-associated regions. As used herein, the phrase, "a set of oligonucleotides that is enriched in oligonucleotides that activate expression of" refers to a set of oligonucleotides that has a greater number of oligonucleotides that activate expression of a target gene (e.g., SMN1 or SMN2) compared with a random selection of oligonucleotides of the same physicochemical properties (e.g., the same GC content, $T_m$, length etc.) as the enriched set.

Where the design and/or synthesis of a single stranded oligonucleotide involves design and/or synthesis of a sequence that is complementary to a nucleic acid or PRC2-associated region described by such sequence information, the skilled person is readily able to determine the complementary sequence, e.g., through understanding of Watson Crick base pairing rules which form part of the common general knowledge in the field.

In some embodiments design and/or synthesis of a single stranded oligonucleotide involves manufacture of an oligonucleotide from starting materials by techniques known to those of skill in the art, where the synthesis may be based on a sequence of a PRC2-associated region, or portion thereof.

Methods of design and/or synthesis of a single stranded oligonucleotide may involve one or more of the steps of:

Identifying and/or selecting PRC2-associated region;

Designing a nucleic acid sequence having a desired degree of sequence identity or complementarity to a PRC2-associated region or a portion thereof;

Synthesizing a single stranded oligonucleotide to the designed sequence;

Purifying the synthesized single stranded oligonucleotide; and

Optionally mixing the synthesized single stranded oligonucleotide with at least one pharmaceutically acceptable diluent, carrier or excipient to form a pharmaceutical composition or medicament.

Single stranded oligonucleotides so designed and/or synthesized may be useful in method of modulating gene expression as described herein.

Preferably, single stranded oligonucleotides of the invention are synthesized chemically. Oligonucleotides used to practice this invention can be synthesized in vitro by well-known chemical synthesis techniques.

Oligonucleotides of the invention can be stabilized against nucleolytic degradation such as by the incorporation of a modification, e.g., a nucleotide modification. For example, nucleic acid sequences of the invention include a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom.

It is understood that any of the modified chemistries or formats of single stranded oligonucleotides described herein can be combined with each other, and that one, two, three, four, five, or more different types of modifications can be included within the same molecule.

In some embodiments, the method may further comprise the steps of amplifying the synthesized single stranded oligonucleotide, and/or purifying the single stranded oligonucleotide (or amplified single stranded oligonucleotide), and/or sequencing the single stranded oligonucleotide so obtained.

As such, the process of preparing a single stranded oligonucleotide may be a process that is for use in the manufacture of a pharmaceutical composition or medicament for use in the treatment of disease, optionally wherein the treatment involves modulating expression of a gene associated with a PRC2-associated region.

In the methods described above a PRC2-associated region may be, or have been, identified, or obtained, by a method that involves identifying RNA that binds to PRC2.

Such methods may involve the following steps: providing a sample containing nuclear ribonucleic acids, contacting the sample with an agent that binds specifically to PRC2 or a subunit thereof, allowing complexes to form between the agent and protein in the sample, partitioning the complexes, synthesizing nucleic acid that is complementary to nucleic acid present in the complexes.

Where the single stranded oligonucleotide is based on a PRC2-associated region, or a portion of such a sequence, it may be based on information about that sequence, e.g., sequence information available in written or electronic form, which may include sequence information contained in publicly available scientific publications or sequence databases.

Nucleotide Analogues

In some embodiments, the oligonucleotide may comprise at least one ribonucleotide, at least one deoxyribonucleotide, and/or at least one bridged nucleotide. In some embodiments, the oligonucleotide may comprise a bridged nucleotide, such as a locked nucleic acid (LNA) nucleotide, a constrained ethyl (cEt) nucleotide, or an ethylene bridged nucleic acid (ENA) nucleotide. Examples of such nucleotides are disclosed herein and known in the art. In some embodiments, the oligonucleotide comprises a nucleotide analog disclosed in one of the following United States Patent or Patent Application Publications: U.S. Pat. No. 7,399,845, U.S. Pat. No. 7,741,457, U.S. Pat. No. 8,022,193, U.S. Pat. No. 7,569,686, U.S. Pat. No. 7,335,765, U.S. Pat. No. 7,314,923, U.S. Pat. No. 7,335,765, and U.S. Pat. No. 7,816,333, US 20110009471, the entire contents of each of which are incorporated herein by reference for all purposes. The oligonucleotide may have one or more 2' O-methyl nucleotides. The oligonucleotide may consist entirely of 2' O-methyl nucleotides.

Often the single stranded oligonucleotide has one or more nucleotide analogues. For example, the single stranded oligonucleotide may have at least one nucleotide analogue that results in an increase in $T_m$ of the oligonucleotide in a range of 1° C., 2° C., 3° C., 4° C., or 5° C. compared with an oligonucleotide that does not have the at least one nucleotide analogue. The single stranded oligonucleotide may have a plurality of nucleotide analogues that results in a total increase in $T_m$ of the oligonucleotide in a range of 2° C., 3° C., 4° C., 5° C., 6° C., 7° C., 8° C., 9° C., 10° C., 15° C., 20° C., 25° C., 30° C., 35° C., 40° C., 45° C. or more compared with an oligonucleotide that does not have the nucleotide analogue.

The oligonucleotide may be of up to 50 nucleotides in length in which 2 to 10, 2 to 15, 2 to 16, 2 to 17, 2 to 18, 2 to 19, 2 to 20, 2 to 25, 2 to 30, 2 to 40, 2 to 45, or more nucleotides of the oligonucleotide are nucleotide analogues. The oligonucleotide may be of 8 to 30 nucleotides in length in which 2 to 10, 2 to 15, 2 to 16, 2 to 17, 2 to 18, 2 to 19, 2 to 20, 2 to 25, 2 to 30 nucleotides of the oligonucleotide are nucleotide analogues.

The oligonucleotide may be of 8 to 15 nucleotides in length in which 2 to 4, 2 to 5, 2 to 6, 2 to 7, 2 to 8, 2 to 9, 2 to 10, 2 to 11, 2 to 12, 2 to 13, 2 to 14 nucleotides of the oligonucleotide are nucleotide analogues. Optionally, the oligonucleotides may have every nucleotide except 1, 2, 3, 4, 5, 6, 7, 8, 9, or 10 nucleotides modified.

The oligonucleotide may consist entirely of bridged nucleotides (e.g., LNA nucleotides, cEt nucleotides, ENA nucleotides). The oligonucleotide may comprise alternating deoxyribonucleotides and 2'-fluoro-deoxyribonucleotides. The oligonucleotide may comprise alternating deoxyribonucleotides and 2'-O-methyl nucleotides. The oligonucleotide may comprise alternating deoxyribonucleotides and ENA nucleotide analogues. The oligonucleotide may comprise alternating deoxyribonucleotides and LNA nucleotides. The oligonucleotide may comprise alternating LNA nucleotides and 2'-O-methyl nucleotides. The oligonucleotide may have a 5' nucleotide that is a bridged nucleotide (e.g., a LNA nucleotide, cEt nucleotide, ENA nucleotide). The oligonucleotide may have a 5' nucleotide that is a deoxyribonucleotide.

The oligonucleotide may comprise deoxyribonucleotides flanked by at least one bridged nucleotide (e.g., a LNA nucleotide, cEt nucleotide, ENA nucleotide) on each of the 5' and 3' ends of the deoxyribonucleotides. The oligonucleotide may comprise deoxyribonucleotides flanked by 1, 2, 3, 4, 5, 6, 7, 8 or more bridged nucleotides (e.g., LNA nucleotides, cEt nucleotides, ENA nucleotides) on each of the 5' and 3' ends of the deoxyribonucleotides. The 3' position of the oligonucleotide may have a 3' hydroxyl group. The 3' position of the oligonucleotide may have a 3' thiophosphate.

The oligonucleotide may be conjugated with a label. For example, the oligonucleotide may be conjugated with a biotin moiety, cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

Preferably the single stranded oligonucleotide comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the single stranded oligonucleotides are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric single stranded oligonucleotides of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the single stranded oligonucleotide comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone, $CH_2$—O—N($CH_3$)—$CH_2$, $CH_2$—N($CH_3$)—N($CH_3$)—$CH_2$ and O—N($CH_3$)—$CH_2$—$CH_2$ backbones, wherein the native phosphodiester backbone is represented as O—P—O—CH); amide backbones (see De Mesmaeker et al. Acc. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues. Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide.

PCT Publication No. WO 99/67378 discloses arabino-nucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-O,4'-C-ethylene-bridged nucleic acids.

Examples of LNAs are described in WO/2008/043753 and include compounds of the following general formula.

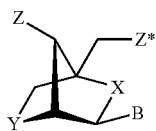

where X and Y are independently selected among the groups —O—,
—S—, —N(H)—, N(R)—, —CH$_2$— or —CH— (if part of a double bond),
—CH$_2$—O—, —CH$_2$—S—, —CH$_2$—N(H)—, —CH$_2$—N(R)—, —CH$_2$—CH$_2$— or —CH$_2$—CH— (if part of a double bond),
—CH=CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligonucleotides described herein comprises at least one LNA unit according any of the formulas

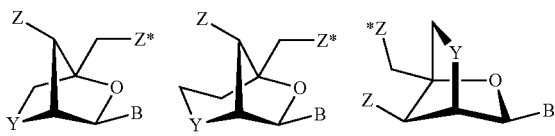

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and C$_{1-4}$-alkyl.

In some embodiments, the Locked Nucleic Acid (LNA) used in the oligonucleotides described herein comprises at least one Locked Nucleic Acid (LNA) unit according any of the formulas shown in Scheme 2 of PCT/DK2006/000512.

In some embodiments, the LNA used in the oligomer of the invention comprises internucleoside linkages selected from —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, where R$^H$ is selected from hydrogen and C$_{1-4}$-alkyl.

Specifically preferred LNA units are shown in scheme 2:

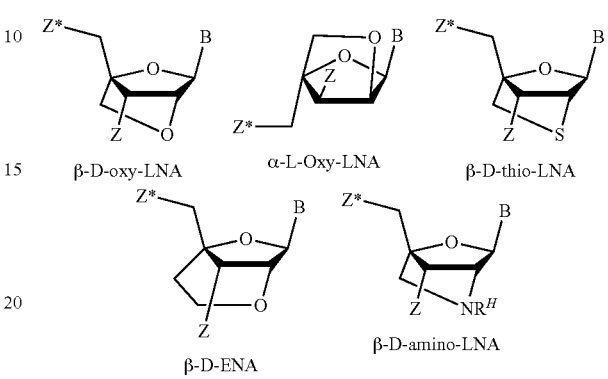

The term "thio-LNA" comprises a locked nucleotide in which at least one of X or Y in the general formula above is selected from S or —CH$_2$—S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)— where R is selected from hydrogen and C$_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail herein.

One or more substituted sugar moieties can also be included, e.g., one of the following at the 2' position: OH, SH, SCH$_3$, F, OCN, OCH$_3$ OCH$_3$, OCH$_3$ O(CH$_2$)n CH$_3$, O(CH$_2$)n NH$_2$ or O(CH$_2$)n CH$_3$ where n is from 1 to about 10; C1 to C10 lower alkyl, alkoxyalkoxy, substituted lower alkyl, alkaryl or aralkyl; Cl; Br; CN; CF$_3$; OCF$_3$; O-, S-, or N-alkyl; O-, S-, or N-alkenyl; SOCH$_3$; SO$_2$CH$_3$; ONO$_2$; NO$_2$; N$_3$; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy [2'-O—CH$_2$CH$_2$OCH$_3$, also known as 2'-O-(2-methoxyethyl)] (Martin et al, Helv. Chim. Acta, 1995, 78, 486). Other preferred modifications include 2'-methoxy (2'-O—CH$_3$), 2'-propoxy (2'-OCH$_2$ CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Single stranded oligonucleotides can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalkylamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2° C. (Sanghvi, in Crooke, and Lebleu, eds., Antisense Research and Applications, CRC Press, Boca Raton, 1993, pp. 276-278) and may be used as base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Single stranded oligonucleotides can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2<0>C (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the single stranded oligonucleotides are chemically linked to one or more moieties or conjugates that enhance the activity, cellular distribution, or cellular uptake of the oligonucleotide. For example, one or more single stranded oligonucleotides, of the same or different types, can be conjugated to each other; or single stranded oligonucleotides can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxycholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963;

5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

In some embodiments, single stranded oligonucleotide modification include modification of the 5' or 3' end of the oligonucleotide. In some embodiments, the 3' end of the oligonucleotide comprises a hydroxyl group or a thiophosphate. It should be appreciated that additional molecules (e.g. a biotin moiety or a fluorophor) can be conjugated to the 5' or 3' end of the single stranded oligonucleotide. In some embodiments, the single stranded oligonucleotide comprises a biotin moiety conjugated to the 5' nucleotide.

In some embodiments, the single stranded oligonucleotide comprises locked nucleic acids (LNA), ENA modified nucleotides, 2'-O-methyl nucleotides, or 2'-fluoro-deoxyribonucleotides. In some embodiments, the single stranded oligonucleotide comprises alternating deoxyribonucleotides and 2'-fluoro-deoxyribonucleotides. In some embodiments, the single stranded oligonucleotide comprises alternating deoxyribonucleotides and 2'-O-methyl nucleotides. In some embodiments, the single stranded oligonucleotide comprises alternating deoxyribonucleotides and ENA modified nucleotides. In some embodiments, the single stranded oligonucleotide comprises alternating deoxyribonucleotides and locked nucleic acid nucleotides. In some embodiments, the single stranded oligonucleotide comprises alternating locked nucleic acid nucleotides and 2'-O-methyl nucleotides.

In some embodiments, the 5' nucleotide of the oligonucleotide is a deoxyribonucleotide. In some embodiments, the 5' nucleotide of the oligonucleotide is a locked nucleic acid nucleotide. In some embodiments, the nucleotides of the oligonucleotide comprise deoxyribonucleotides flanked by at least one locked nucleic acid nucleotide on each of the 5' and 3' ends of the deoxyribonucleotides. In some embodiments, the nucleotide at the 3' position of the oligonucleotide has a 3' hydroxyl group or a 3' thiophosphate.

In some embodiments, the single stranded oligonucleotide comprises phosphorothioate internucleotide linkages. In some embodiments, the single stranded oligonucleotide comprises phosphorothioate internucleotide linkages between at least two nucleotides. In some embodiments, the single stranded oligonucleotide comprises phosphorothioate internucleotide linkages between all nucleotides.

It should be appreciated that the single stranded oligonucleotide can have any combination of modifications as described herein.

The oligonucleotide may comprise a nucleotide sequence having one or more of the following modification patterns.

(a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXXxx, (X)XxxXXx, (X)XxxxXX, (X)XxxXXx (X)XxxxXX, (X)xXxXXx, (X)xXxxXX, (X)xxXxXX, (X)xXxXxX and (X)XxXxXx, (d) (X)xxXXX, (X)xXxXXX, (X)xXXxXX, (X)xXXXxX, (X)xXXXXx, (X)XxxXXXX, (X)XxXxXXX, (X)XxXxXXX, (X)XxXXxX, (X)XxXXXx, (X)XXxxXXX, (X)XXxXxX, (X)XXXxxX, (X)XXXxXx, (X)XXXXxx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, in which "X" denotes a nucleotide analogue, (X) denotes an optional nucleotide analogue, and "x" denotes a DNA or RNA nucleotide unit. Each of the above listed patterns may appear one or more times within an oligonucleotide, alone or in combination with any of the other disclosed modification patterns.

Methods for Modulating Gene Expression

In some embodiments, methods are provided for increasing expression of SMN protein in a cell. The methods, in some embodiments, involve delivering to the cell a first single stranded oligonucleotide complementary with a PRC2-associated region of SMN1 or SMN2 and a second single stranded oligonucleotide complementary with a splice control sequence of a precursor mRNA of SMN1 or SMN2, in amounts sufficient to increase expression of a mature mRNA of SMN1 or SMN2 that comprises (or includes) exon 7 in the cell. The first and second single stranded oligonucleotides may be delivered together or separately. The first and second single stranded oligonucleotides may be linked together, or unlinked, i.e., separate.

In some embodiments, methods are provided for treating spinal muscular atrophy in a subject. The methods, in some embodiments, involve administering to a subject a first single stranded oligonucleotide complementary with a PRC2-associated region of SMN1 or SMN2 and a second single stranded oligonucleotide complementary with a splice control sequence of a precursor mRNA of SMN1 or SMN2, in amounts sufficient to increase expression of full length SMN protein in the subject to levels sufficient to improve one or more conditions associated with SMA. The first and second single stranded oligonucleotides may be administered together or separately. The first and second single stranded oligonucleotides may be linked together, or unlinked, i.e., separate. The first single stranded oligonucleotide may be administered within 1 hour, 2 hours, 3 hours, 4 hours, 8 hours, 12 hours, 24 hours, 48 hours or more of administration of the second single stranded oligonucleotide. The first single stranded oligonucleotide may be administered before or after the second single stranded oligonucleotide. The oligonucleotides may be administered once or on multiple occasions depending on the needs of the subject and/or judgment of the treating physician. In some cases, the oligonucleotides may be administered in cycles. The administration cycles may vary; for example, the administration cycle may be $2^{nd}$ oligo-$1^{st}$ oligo-$2^{nd}$ oligo-$1^{st}$ oligo and so on; or $1^{st}$ oligo-$2^{nd}$ oligo-$1^{st}$ oligo-$2^{nd}$ oligo, and so on; or $1^{st}$ oligo-$2^{nd}$ oligo-$2^{nd}$ oligo-$1^{st}$ oligo-$1^{st}$ oligo-$2^{nd}$ oligo-$2^{nd}$ oligo-$1^{st}$ oligo, and so on. The skilled artisan will be capable of selecting administration cycles and intervals between each administration that are appropriate for treating a particular subject.

In one aspect, the invention relates to methods for modulating gene expression in a cell (e.g., a cell for which SMN1 or SMN2 levels are reduced) for research purposes (e.g., to study the function of the gene in the cell). In another aspect, the invention relates to methods for modulating gene expression in a cell (e.g., a cell for which SMN1 or SMN2 levels are reduced) for gene or epigenetic therapy. The cells can be in vitro, ex vivo, or in vivo (e.g., in a subject who has a disease resulting from reduced expression or activity of SMN1 or SMN2. In some embodiments, methods for modulating gene expression in a cell comprise delivering a single stranded oligonucleotide as described herein. In some embodiments, delivery of the single stranded oligonucleotide to the cell results in a level of expression of gene that is at least 5%, 10%, 20%, 30%, 40%, 50%, 60%, 70%, 80%, 90%, 100%, 200% or more greater than a level of expression of gene in a control cell to which the single stranded oligonucleotide has not been delivered. In certain embodiments, delivery of the single stranded oligonucleotide to the cell results in a level of expression of gene that is at least 50% greater than a level of expression of gene in a control cell to which the single stranded oligonucleotide has not been delivered.

In another aspect of the invention, methods comprise administering to a subject (e.g. a human) a composition comprising a single stranded oligonucleotide as described herein to increase protein levels in the subject. In some embodiments, the increase in protein levels is at least 5%, 10%, 20%, 30%, 40%, 50%, 60%, 70%, 80%, 90%, 100%, 200%, or more, higher than the amount of a protein in the subject before administering.

As another example, to increase expression of SMN1 or SMN2 in a cell, the methods include introducing into the cell a single stranded oligonucleotide that is sufficiently complementary to a PRC2-associated region (e.g., of a long noncoding RNA) that maps to a genomic position encompassing or in proximity to the SMN1 or SMN2 gene.

In another aspect of the invention provides methods of treating a condition (e.g., Spinal muscular atrophy) associated with decreased levels of expression of SMN1 or SMN2 in a subject, the method comprising administering a single stranded oligonucleotide as described herein.

A subject can include a non-human mammal, e.g. mouse, rat, guinea pig, rabbit, cat, dog, goat, cow, or horse. In preferred embodiments, a subject is a human. Single stranded oligonucleotides have been employed as therapeutic moieties in the treatment of disease states in animals, including humans. Single stranded oligonucleotides can be useful therapeutic modalities that can be configured to be useful in treatment regimes for the treatment of cells, tissues and animals, especially humans.

For therapeutics, an animal, preferably a human, suspected of having Spinal muscular atrophy is treated by administering single stranded oligonucleotide in accordance with this invention. For example, in one non-limiting embodiment, the methods comprise the step of administering to the animal in need of treatment, a therapeutically effective amount of a single stranded oligonucleotide as described herein.

Formulation, Delivery, and Dosing

The oligonucleotides described herein can be formulated for administration to a subject for treating a condition (e.g., Spinal muscular atrophy) associated with decreased levels of SMN protein. It should be understood that the formulations, compositions and methods can be practiced with any of the oligonucleotides disclosed herein. In some embodiments, formulations are provided that comprise a first single stranded oligonucleotide complementary with a PRC2-associated region of a gene and a second single stranded oligonucleotide complementary to a splice control sequence of a precursor mRNA of the gene. In some embodiments, formulations are provided that comprise a first single stranded oligonucleotide complementary with a PRC2-associated region of a gene that is linked via a linker with a second single stranded oligonucleotide complementary to a splice control sequence of a precursor mRNA of the gene. Thus, it should be appreciated that in some embodiments, a first single stranded oligonucleotide complementary with a PRC2-associated region of a gene is linked with a second single stranded oligonucleotide complementary to a splice control sequence of a precursor mRNA of the gene, and in other embodiments, the single stranded oligonucleotides are not linked. Single stranded oligonucleotides that are not linked may be administered to a subject or delivered to a cell simultaneously (e.g., within the same composition) or separately.

The formulations may conveniently be presented in unit dosage form and may be prepared by any methods well known in the art of pharmacy. The amount of active ingredient (e.g., an oligonucleotide or compound of the invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g. tumor regression.

Pharmaceutical formulations of this invention can be prepared according to any method known to the art for the manufacture of pharmaceuticals. Such formulations can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

A formulated single stranded oligonucleotide composition can assume a variety of states. In some examples, the composition is at least partially crystalline, uniformly crystalline, and/or anhydrous (e.g., less than 80, 50, 30, 20, or 10% water). In another example, the single stranded oligonucleotide is in an aqueous phase, e.g., in a solution that includes water. The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the single stranded oligonucleotide composition is formulated in a manner that is compatible with the intended method of administration.

In some embodiments, the composition is prepared by at least one of the following methods: spray drying, lyophilization, vacuum drying, evaporation, fluid bed drying, or a combination of these techniques; or sonication with a lipid, freeze-drying, condensation and other self-assembly.

A single stranded oligonucleotide preparation can be formulated or administered (together or separately) in combination with another agent, e.g., another therapeutic agent or an agent that stabilizes a single stranded oligonucleotide, e.g., a protein that complexes with single stranded oligonucleotide. Still other agents include chelators, e.g., EDTA (e.g., to remove divalent cations such as $Mg^{2+}$), salts, RNAse inhibitors (e.g., a broad specificity RNAse inhibitor such as RNAsin) and so forth. In some embodiments, the other agent used in combination with the single stranded oligonucleotide is an agent that also regulates SMN expression. In some embodiments, the other agent is a growth hormone, a histone deacetylase inhibitor, a hydroxycarbamide (hydroxyurea), a natural polyphenol compound (e.g., resveratrol, curcumin), prolactin, or salbutamol. Examples of histone deacetylase inhibitors that may be used include aliphatic compounds (e.g., butyrates (e.g., sodium butyrate and sodium phenylbutyrate) and valproic acid), benzamides (e.g., M344), and hydroxamic acids (e.g., CBHA, SBHA, Entinostat (MS-275)) Panobinostat (LBH-589), Trichostatin A, Vorinostat (SAHA)), In one embodiment, the single stranded oligonucleotide preparation includes another single stranded oligonucleotide, e.g., a second single stranded oligonucleotide that modulates expression and/or mRNA processing of a second gene or a second single stranded oligonucleotide that modulates expression of the first gene. Still other preparation can include at least 3, 5, ten, twenty, fifty, or a hundred or more different single stranded oligonucleotide species. Such single stranded oligonucleotides can mediated gene expression with respect to a similar number of different genes. In one embodiment, the single stranded oligonucleotide preparation includes at least a second therapeutic agent (e.g., an agent other than an oligonucleotide).

Route of Delivery

A composition that includes a single stranded oligonucleotide can be delivered to a subject by a variety of routes. Exemplary routes include: intravenous, intradermal, topical, rectal, parenteral, anal, intravaginal, intranasal, pulmonary, ocular. The term "therapeutically effective amount" is the amount of oligonucleotide present in the composition that is needed to provide the desired level of SMN1 or SMN2 expression in the subject to be treated to give the anticipated physiological response. The term "physiologically effective amount" is that amount delivered to a subject to give the desired palliative or curative effect. The term "pharmaceutically acceptable carrier" means that the carrier can be administered to a subject with no significant adverse toxicological effects to the subject.

The single stranded oligonucleotide molecules of the invention can be incorporated into pharmaceutical compositions suitable for administration. Such compositions typically include one or more species of single stranded oligonucleotide and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present invention may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the single stranded oligonucleotide in aerosol form. The vascular endothelial cells could be targeted by coating a balloon catheter with the single stranded oligonucleotide and mechanically introducing the oligonucleotide.

Topical administration refers to the delivery to a subject by contacting the formulation directly to a surface of the subject. The most common form of topical delivery is to the skin, but a composition disclosed herein can also be directly applied to other surfaces of the body, e.g., to the eye, a mucous membrane, to surfaces of a body cavity or to an internal surface. As mentioned above, the most common topical delivery is to the skin. The term encompasses several routes of administration including, but not limited to, topical and transdermal. These modes of administration typically include penetration of the skin's permeability barrier and efficient delivery to the target tissue or stratum. Topical administration can be used as a means to penetrate the epidermis and dermis and ultimately achieve systemic delivery of the composition. Topical administration can also be used as a means to selectively deliver oligonucleotides to the epidermis or dermis of a subject, or to specific strata thereof, or to an underlying tissue.

Formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Transdermal delivery is a valuable route for the administration of lipid soluble therapeutics. The dermis is more permeable than the epidermis and therefore absorption is much more rapid through abraded, burned or denuded skin. Inflammation and other physiologic conditions that increase blood flow to the skin also enhance transdermal adsorption. Absorption via this route may be enhanced by the use of an oily vehicle (inunction) or through the use of one or more penetration enhancers. Other effective ways to deliver a composition disclosed herein via the transdermal route include hydration of the skin and the use of controlled release topical patches. The transdermal route provides a potentially effective means to deliver a composition disclosed herein for systemic and/or local therapy. In addition, iontophoresis (transfer of ionic solutes through biological membranes under the influence of an electric field), phonophoresis or sonophoresis (use of ultrasound to enhance the absorption of various therapeutic agents across biological membranes, notably the skin and the cornea), and optimization of vehicle characteristics relative to dose position and retention at the site of administration may be useful methods for enhancing the transport of topically applied compositions across skin and mucosal sites.

Both the oral and nasal membranes offer advantages over other routes of administration. For example, oligonucleotides administered through these membranes may have a rapid onset of action, provide therapeutic plasma levels, avoid first pass effect of hepatic metabolism, and avoid exposure of the oligonucleotides to the hostile gastrointestinal (GI) environment. Additional advantages include easy access to the membrane sites so that the oligonucleotide can be applied, localized and removed easily.

In oral delivery, compositions can be targeted to a surface of the oral cavity, e.g., to sublingual mucosa which includes the membrane of ventral surface of the tongue and the floor of the mouth or the buccal mucosa which constitutes the lining of the cheek. The sublingual mucosa is relatively permeable thus giving rapid absorption and acceptable bioavailability of many agents. Further, the sublingual mucosa is convenient, acceptable and easily accessible.

A pharmaceutical composition of single stranded oligonucleotide may also be administered to the buccal cavity of a human being by spraying into the cavity, without inhalation, from a metered dose spray dispenser, a mixed micellar pharmaceutical formulation as described above and a propellant. In one embodiment, the dispenser is first shaken prior to spraying the pharmaceutical formulation and propellant into the buccal cavity.

Compositions for oral administration include powders or granules, suspensions or solutions in water, syrups, slurries, emulsions, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening and/or flavoring agents can be added.

Parenteral administration includes intravenous drip, subcutaneous, intraperitoneal or intramuscular injection, intrathecal or intraventricular administration. In some embodiments, parental administration involves administration directly to the site of disease (e.g. injection into a tumor).

Formulations for parenteral administration may include sterile aqueous solutions which may also contain buffers, diluents and other suitable additives. Intraventricular injection may be facilitated by an intraventricular catheter, for example, attached to a reservoir. For intravenous use, the total concentration of solutes should be controlled to render the preparation isotonic.

Any of the single stranded oligonucleotides described herein can be administered to ocular tissue. For example, the compositions can be applied to the surface of the eye or nearby tissue, e.g., the inside of the eyelid. For ocular administration, ointments or droppable liquids may be delivered by ocular delivery systems known to the art such as applicators or eye droppers. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents and/or carriers. The single stranded oligonucleotide can also be administered to the interior of the eye, and can be introduced by a needle or other delivery device which can introduce it to a selected area or structure.

Pulmonary delivery compositions can be delivered by inhalation by the patient of a dispersion so that the composition, preferably single stranded oligonucleotides, within the dispersion can reach the lung where it can be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self-contained. Dry powder dispersion devices, for example, deliver agents that may be readily formulated as dry powders. A single stranded oligonucleotide composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

The term "powder" means a composition that consists of finely dispersed solid particles that are free flowing and capable of being readily dispersed in an inhalation device and subsequently inhaled by a subject so that the particles reach the lungs to permit penetration into the alveoli. Thus, the powder is said to be "respirable." Preferably the average particle size is less than about 10 µm in diameter preferably with a relatively uniform spheroidal shape distribution. More preferably the diameter is less than about 7.5 µm and most preferably less than about 5.0 µm. Usually the particle size distribution is between about 0.1 µm and about 5 µm in diameter, particularly about 0.3 µm to about 5 µm.

The term "dry" means that the composition has a moisture content below about 10% by weight (% w) water, usually below about 5% w and preferably less it than about 3% w. A dry composition can be such that the particles are readily dispersible in an inhalation device to form an aerosol.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Suitable pH adjusters or buffers include organic salts prepared from organic acids and bases, such as sodium citrate, sodium ascorbate, and the like; sodium citrate is preferred. Pulmonary administration of a micellar single stranded oligonucleotide formulation may be achieved through metered dose spray devices with propellants such as tetrafluoroethane, heptafluoroethane, dimethylfluoropropane, tetrafluoropropane, butane, isobutane, dimethyl ether and other non-CFC and CFC propellants.

Exemplary devices include devices which are introduced into the vasculature, e.g., devices inserted into the lumen of a vascular tissue, or which devices themselves form a part of the vasculature, including stents, catheters, heart valves, and other vascular devices. These devices, e.g., catheters or stents, can be placed in the vasculature of the lung, heart, or leg.

Other devices include non-vascular devices, e.g., devices implanted in the peritoneum, or in organ or glandular tissue, e.g., artificial organs. The device can release a therapeutic substance in addition to a single stranded oligonucleotide, e.g., a device can release insulin.

In one embodiment, unit doses or measured doses of a composition that includes single stranded oligonucleotide are dispensed by an implanted device. The device can include a sensor that monitors a parameter within a subject. For example, the device can include pump, e.g., and, optionally, associated electronics.

Tissue, e.g., cells or organs can be treated with a single stranded oligonucleotide, ex vivo and then administered or implanted in a subject. The tissue can be autologous, allogeneic, or xenogeneic tissue. E.g., tissue can be treated to reduce graft v. host disease. In other embodiments, the tissue is allogeneic and the tissue is treated to treat a disorder characterized by unwanted gene expression in that tissue. E.g., tissue, e.g., hematopoietic cells, e.g., bone marrow hematopoietic cells, can be treated to inhibit unwanted cell proliferation. Introduction of treated tissue, whether autologous or transplant, can be combined with other therapies. In some implementations, the single stranded oligonucleotide treated cells are insulated from other cells, e.g., by a semi-permeable porous barrier that prevents the cells from leaving the implant, but enables molecules from the body to reach the cells and molecules produced by the cells to enter the body. In one embodiment, the porous barrier is formed from alginate.

In one embodiment, a contraceptive device is coated with or contains a single stranded oligonucleotide. Exemplary devices include condoms, diaphragms, IUD (implantable uterine devices, sponges, vaginal sheaths, and birth control devices.

Dosage

In one aspect, the invention features a method of administering a single stranded oligonucleotide (e.g., as a compound or as a component of a composition) to a subject (e.g., a human subject). In some embodiments, the methods involve administering a compound (e.g., a compound of the general formula A-B-C, as disclosed herein, or an single stranded oligonucleotide) in a unit dose to a subject. In one embodiment, the unit dose is between about 10 mg and 25 mg per kg of bodyweight. In one embodiment, the unit dose is between about 1 mg and 100 mg per kg of bodyweight. In one embodiment, the unit dose is between about 0.1 mg and 500 mg per kg of bodyweight. In some embodiments, the unit dose is more than 0.001, 0.005, 0.01, 0.05, 0.1, 0.5, 1, 2, 5, 10, 25, 50 or 100 mg per kg of bodyweight.

The defined amount can be an amount effective to treat or prevent a disease or disorder, e.g., a disease or disorder associated with the SMN1 or SMN2. The unit dose, for example, can be administered by injection (e.g., intravenous or intramuscular), an inhaled dose, or a topical application.

In some embodiments, the unit dose is administered daily. In some embodiments, less frequently than once a day, e.g., less than every 2, 4, 8 or 30 days. In another embodiment, the unit dose is not administered with a frequency (e.g., not a regular frequency). For example, the unit dose may be administered a single time. In some embodiments, the unit dose is administered more than once a day, e.g., once an hour, two hours, four hours, eight hours, twelve hours, etc.

In one embodiment, a subject is administered an initial dose and one or more maintenance doses of a single stranded oligonucleotide. The maintenance dose or doses are generally lower than the initial dose, e.g., one-half less of the initial dose. A maintenance regimen can include treating the subject with a dose or doses ranging from 0.0001 to 100 mg/kg of body weight per day, e.g., 100, 10, 1, 0.1, 0.01, 0.001, or 0.0001 mg per kg of bodyweight per day. The maintenance doses may be administered no more than once every 1, 5, 10, or 30 days. Further, the treatment regimen may last for a period of time which will vary depending upon the nature of the particular disease, its severity and the overall condition of the patient. In some embodiments the dosage may be delivered no more than once per day, e.g., no more than once per 24, 36, 48, or more hours, e.g., no more than once for every 5 or 8 days. Following treatment, the patient can be monitored for changes in his condition and for alleviation of the symptoms of the disease state. The dosage of the oligonucleotide may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

In some embodiments, the pharmaceutical composition includes a plurality of single stranded oligonucleotide species. In some embodiments, the pharmaceutical composition comprises a first single stranded oligonucleotide complementary with a PRC2-associated region of a gene (e.g., SMN1 or SMN2), and a second single stranded oligonucleotide complementary to a splice control sequence of a precursor mRNA of a gene (e.g., SMN1 or SMN2). In some embodiments, the pharmaceutical composition includes a compound comprising the general formula A-B-C, in which A is a single stranded oligonucleotide complementary with a PRC2-associated region of a gene, B is a linker, and C is a single stranded oligonucleotide complementary to a splice control sequence of a precursor mRNA of the gene.

In another embodiment, the single stranded oligonucleotide species has sequences that are non-overlapping and non-adjacent to another species with respect to a naturally occurring target sequence (e.g., a PRC2-associated region). In another embodiment, the plurality of single stranded oligonucleotide species is specific for different PRC2-associated regions. In another embodiment, the single stranded oligonucleotide is allele specific. In some cases, a patient is treated with a single stranded oligonucleotide in conjunction with other therapeutic modalities.

Following successful treatment, it may be desirable to have the patient undergo maintenance therapy to prevent the recurrence of the disease state, wherein the compound of the invention is administered in maintenance doses, ranging from 0.0001 mg to 100 mg per kg of body weight.

The concentration of the single stranded oligonucleotide composition is an amount sufficient to be effective in treating or preventing a disorder or to regulate a physiological condition in humans. The concentration or amount of single stranded oligonucleotide administered will depend on the parameters determined for the agent and the method of administration, e.g. nasal, buccal, pulmonary. For example, nasal formulations may tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a single stranded oligonucleotide can include a single treatment or, preferably, can include a series of treatments. It will also be appreciated that the effective dosage of a single stranded oligonucleotide used for treatment may increase or decrease over the course of a particular treatment. For example, the subject can be monitored after administering a single stranded oligonucleotide composition. Based on information from the monitoring, an additional amount of the single stranded oligonucleotide composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of SMN1 or SMN2 expression levels in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models. In some embodiments, the animal models include transgenic animals that express a human SMN1 or SMN2. In another embodiment, the composition for testing includes a single stranded oligonucleotide that is complementary, at least in an internal region, to a sequence that is conserved between SMN1 or SMN2 in the animal model and the SMN1 or SMN2 in a human.

In one embodiment, the administration of the single stranded oligonucleotide composition is parenteral, e.g. intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The composition can be provided in measured doses or in a dispenser which delivers a metered dose. Selected modes of delivery are discussed in more detail below.

Kits

In certain aspects of the invention, kits are provided, comprising a container housing a composition comprising a single stranded oligonucleotide. In some embodiments, the kits comprise a container housing a single stranded oligonucleotide complementary with of a PRC2-associated region of a gene; and a second container housing a single stranded oligonucleotide complementary to a splice control sequence of a precursor mRNA of the gene. In some embodiments, the kits comprise a container housing a single stranded oligonucleotide complementary with of a PRC2-associated region of a gene and a single stranded oligonucleotide complementary to a splice control sequence of a precursor mRNA of the gene. In some embodiments, the composition is a pharmaceutical composition comprising a single stranded oligonucleotide and a pharmaceutically acceptable carrier. In some embodiments, the individual components of the pharmaceutical composition may be provided in one container. Alternatively, it may be desirable to provide the components of the pharmaceutical composition separately in two or more containers, e.g., one container for single stranded oligonucleotides, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

The present invention is further illustrated by the following Examples, which in no way should be construed as further limiting. The entire contents of all of the references (including literature references, issued patents, published patent applications, and co-pending patent applications) cited throughout this application are hereby expressly incorporated by reference.

EXAMPLES

The invention is further described in the following examples, which do not limit the scope of the invention described in the claims.

Example 1: Oligonucleotides Targeting PRC2-Associated Regions that Upregulate SMN1

Materials and Methods:
Real Time PCR

RNA was harvested from the cells using Promega SV 96 Total RNA Isolation system or Trizol omitting the DNAse step. In separate pilot experiments, 50 ng of RNA was determined to be sufficient template for the reverse transcriptase reaction. RNA harvested from cells was normalized so that 50 ng of RNA was input to each reverse transcription reaction. For the few samples that were too dilute to reach this limit, the maximum input volume was added. Reverse transcriptase reaction was performed using the Superscript II kit and real time PCR performed on cDNA samples using icycler SYBR green chemistry (Biorad). A baseline level of mRNA expression for each target gene was determined through quantitative PCR as outlined above. Baseline levels were also determined for mRNA of various housekeeping genes which are constitutively expressed. A "control" housekeeping gene with approximately the same level of baseline expression as the target gene was chosen for comparison purposes.

Protein Expression (ELISA)

ELISA to determine SMN protein was carried out per manufacturer's instructions (SMN ELISA kit #ADI-900-209, Enzo Life Sciences).

Cell Culture

Human hepatocyte Hep3B, human hepatocyte HepG2 cells, mouse hepatoma Hepa1-6 cells, and human renal proximal tubule epithelial cells (RPTEC) were cultured using conditions known in the art (see, e.g. Current Protocols in Cell Biology). Other cell lines tested were neuronal cell lines (SK-N-AS, U-87) and SMN patient fibroblasts. Details of the cell lines used in the experiments described herein are provided in Table 8.

TABLE 8

Cell lines

| Cell line | Source | Species | Gender | Cell Type | Tissue | Status | Culture Conditions |
| --- | --- | --- | --- | --- | --- | --- | --- |
| RPTEC | Lonza | human | N/A | proximal tubule epithelial cells | kidney | primary | Clonetics ™ REGM ™ BulletKit ™ (CC-3190) |
| Hep3B | ATCC | human | M | hepatocytes | liver | immortalized | Eagle's MEM + 10% FBS |
| SK-N-AS | ATCC | human | F | neuroblast | brain | immortalized | DMEM + 10% FBS |
| U-87 | ATCC | human | M | gliobastoma | brain | immortalized | Eagle's MEM + 10% FBS |
| GM03813 | Coriell Institute | human | F | fibroblast | skin | immortalized | MEM + 10% FBS |
| GM03814 | Coriell Institute | human | M | fibroblast | skin | immortalized | MEM + 10% FBS |
| GM09677 | Coriell Institute | human | M | fibroblast | skin | immortalized | MEM + 10% FBS |
| GM00232 | Coriell Institute | human | M | fibroblast | skin | immortalized | MEM + 10% FBS |
| GM03815 | Coriell Institute | human | M | fibroblast | skin | immortalized | MEM + 10% FBS |
| GM22592 | Coriell Institute | human | M | fibroblast | skin | immortalized | MEM + 10% FBS |
| GM10684 | Coriell Institute | human | F | B-lymphocyte | blood | immortalized | MEM + 10% FBS |
| GM00321 (normal) | Coriell Institute | human | F | fibroblast | skin | immortalized | MEM + 10% FBS |

Oligonucleotide Design

Oligonucleotides were designed within PRC2-interacting regions in order to upregulate SMN1. The sequence and structure of each oligonucleotide is shown in Table 2. The following table provides a description of the nucleotide analogs, modifications and intranucleotide linkages used for certain oligonucleotides tested and described in Table 2.

In Vitro Transfection of Cells with Oligonucleotides

Cells were seeded into each well of 24-well plates at a density of 25,000 cells per 500 uL and transfections were performed with Lipofectamine and the single stranded oligonucleotides. Control wells contained Lipofectamine alone. At 48 hours post-transfection, approximately 200 uL of cell culture supernatants were stored at −80 C for ELISA. At 48 hours post-transfection, RNA was harvested from the cells and quantitative PCR was carried out as outlined above. The percent induction of target mRNA expression by each oligonucleotide was determined by normalizing mRNA levels in the presence of the oligonucleotide to the mRNA levels in the presence of control (Lipofectamine alone). This was compared side-by-side with the increase in mRNA expression of the "control" housekeeping gene.

Results:

In Vitro Delivery of Single Stranded Oligonucleotides Upregulated SMN1 Expression Oligonucleotides were designed as candidates for upregulating SMN1 expression. A total of 52 single stranded oligonucleotides were designed to be complementary to a PRC2-interacting region within a sequence as set forth in SEQ ID NO: 1, 2, 4, or 5. Oligonucleotides were tested in at least duplicate. The sequence and structural features of the oligonucleotides are set forth in Table 2. Briefly, cells were transfected in vitro with the oligonucleotides as described above. SMN1 expression in cells following treatment was evaluated by qRT-PCR. Oligonucleotides that upregulated SMN1 expression were identified. Further details are outlined in Table 2.

Table 5 shows further results from experiments in which oligonucleotides were transfected into cells at a particular concentration ([oligo] and 48 or 72 h later RNA was prepared and qRTPCR assays carried out to determine mRNA levels of full length (FL) or delta7 SMN. In other cases, oligos were administered gymnotically to cells at 10 μM and RNA harvested 9 days post treatment. The cell lines tested were neuronal cell lines (SK-N-AS, U-87) and SMN patient fibroblasts.

Table 6 shows results from experiments in which oligonucleotides were transfected into cells in combination with either one or two more oligos or small molecule compounds at a particular concentration ([oligo], [2nd], [3rd]) and 48 or 72 h later RNA was prepared and qRTPCR assays carried out to determine mRNA levels of full length (FL) or delta7 SMN. The cell lines tested were SMN patient fibroblasts.

Table 7 shows results from experiments in which oligonucleotides were transfected into cells in combination with either one or two more oligos or as dimers or by gymnotic treatment at a particular concentration ([oligo], [2nd], [3rd]) and 24, 48, 72 or 216 h later cell lysates were prepared and ELISA assays carried out to determine SMN protein levels. The cell lines tested were SMN patient fibroblasts.

Tables

TABLE 1

Non-Seed hexamer sequences.

AAAAAA, AAAAAG, AAAACA, AAAAGA, AAAAGC, AAAAGG, AAAAUA, AAACAA, AAACAC, AAACAG,
AAACAU, AAACCC, AAACCU, AAACGA, AAACGC, AAACGU, AAACUA, AAACUC, AAACUU, AAAGAU,
AAAGCC, AAAGGA, AAAGGG, AAAGUC, AAAUAC, AAAUAU, AAAUCG, AAAUCU, AAAUGC, AAAUGU,
AAAUUA, AAAUUG, AACAAC, AACAAG, AACAAU, AACACA, AACACG, AACAGA, AACAGC, AACAGG,
AACAUC, AACAUG, AACCAA, AACCAC, AACCAG, AACCAU, AACCCC, AACCCG, AACCGA, AACCGC,
AACCGG, AACCUA, AACCUU, AACGAA, AACGAC, AACGAG, AACGAU, AACGCU, AACGGG, AACGGU,
AACGUA, AACGUC, AACGUG, AACGUU, AACUAU, AACUCA, AACUCC, AACUCG, AACUGA, AACUGC,
AACUGU, AACUUA, AACUUC, AACUUG, AACUUU, AAGAAA, AAGAAG, AAGAAU, AAGACG, AAGAGA,
AAGAGC, AAGAGG, AAGAGU, AAGAUU, AAGCAA, AAGCAC, AAGCAG, AAGCAU, AAGCCA, AAGCCC,
AAGCCG, AAGCCU, AAGCGA, AAGCGG, AAGCGU, AAGCUA, AAGGAA, AAGGAC, AAGGCU, AAGGGC,
AAGGGU, AAGGUU, AAGUAA, AAGUAC, AAGUAU, AAGUCC, AAGUCG, AAGUGA, AAGUGG, AAGUUA,
AAGUUU, AAUAAA, AAUAAC, AAUAAG, AAUAAU, AAUACA, AAUACC, AAUACG, AAUAGA, AAUAGC,
AAUAGG, AAUAGU, AAUAUC, AAUAUU, AAUCAA, AAUCAU, AAUCCA, AAUCCC, AAUCCG, AAUCGA,
AAUCGC, AAUCGU, AAUCUA, AAUCUG, AAUCUU, AAUGAA, AAUGAC, AAUGAG, AAUGAU, AAUGCG,
AAUGCU, AAUGGA, AAUGGU, AAUGUA, AAUGUC, AAUGUG, AAUUAA, AAUUAC, AAUUAG, AAUUCC,
AAUUCG, AAUUGA, AAUUGG, AAUUGU, AAUUUC, AAUUUG, ACAAAA, ACAAAC, ACAAAG, ACAAAU,
ACAACC, ACAACG, ACAACU, ACAAGA, ACAAGC, ACAAGU, ACAAUC, ACAAUG, ACAAUU, ACACAG,
ACACCA, ACACCC, ACACCG, ACACCU, ACACGA, ACACGC, ACACGU, ACACUC, ACACUG, ACACUU,
ACAGAA, ACAGAC, ACAGCC, ACAGCG, ACAGCU, ACAGGG, ACAGUC, ACAGUG, ACAGUU, ACAUAA,
ACAUAC, ACAUCC, ACAUCG, ACAUCU, ACAUGA, ACAUGC, ACAUGU, ACAUUG, ACAUUU, ACCAAA,
ACCAAC, ACCAAG, ACCAAU, ACCACC, ACCACG, ACCAGA, ACCAGU, ACCAUA, ACCAUG, ACCAUU,
ACCCAA, ACCCAC, ACCCCA, ACCCCG, ACCCGA, ACCCGC, ACCCUA, ACCCUC, ACCCUU, ACCGAA,
ACCGAC, ACCGAU, ACCGCA, ACCGCC, ACCGCG, ACCGCU, ACCGGA, ACCGGC, ACCGGU, ACCGUA,
ACCGUC, ACCGUG, ACCGUU, ACCUAA, ACCUAC, ACCUAG, ACCUAU, ACCUCA, ACCUCC, ACCUCG,
ACCUCU, ACCUGA, ACCUGC, ACCUGU, ACCUUA, ACCUUC, ACCUUU, ACGAAA, ACGAAC, ACGAAG,
ACGAAU, ACGACA, ACGACC, ACGACG, ACGACU, ACGAGA, ACGAGC, ACGAGG, ACGAGU, ACGAUA,
ACGAUC, ACGAUG, ACGAUU, ACGCAA, ACGCAG, ACGCAU, ACGCCC, ACGCCG, ACGCCU, ACGCGA,
ACGCGG, ACGCGU, ACGCUA, ACGCUG, ACGCUU, ACGGAA, ACGGAC, ACGGAG, ACGGAU, ACGGCC,
ACGGCG, ACGGCU, ACGGGC, ACGGGG, ACGGGU, ACGGUA, ACGGUC, ACGGUG, ACGGUU, ACGUAA,
ACGUAC, ACGUAU, ACGUCC, ACGUCG, ACGUCU, ACGUGA, ACGUGC, ACGUGG, ACGUGU, ACGUUA,
ACGUUC, ACGUUG, ACGUUU, ACUAAA, ACUAAG, ACUAAU, ACUACA, ACUACC, ACUACG, ACUACU,
ACUAGG, ACUAUC, ACUAUG, ACUAUU, ACUCAU, ACUCCC, ACUCCG, ACUCCU, ACUCGA, ACUCGC,
ACUCGG, ACUCUC, ACUCUU, ACUGAG, ACUGAU, ACUGCC, ACUGCG, ACUGCU, ACUGGG, ACUGGU,
ACUGUC, ACUUAA, ACUUAC, ACUUAU, ACUUCA, ACUUCC, ACUUCG, ACUUCU, ACUUGA, ACUUGC,
ACUUGU, ACUUUA, ACUUUC, ACUUUG, AGAAAA, AGAAAC, AGAAAG, AGAACC, AGAACG, AGAACU,
AGAAGC, AGAAGU, AGAAUA, AGAAUC, AGAAUG, AGAAUU, AGACAA, AGACAC, AGACAU, AGACCA,
AGACCC, AGACCG, AGACCU, AGACGA, AGACGC, AGACGU, AGACUA, AGACUC, AGACUU, AGAGAC,
AGAGAG, AGAGAU, AGAGCC, AGAGCG, AGAGCU, AGAGGC, AGAGGG, AGAGGU, AGAGUA, AGAGUU,

TABLE 1 -continued

Non-Seed hexamer sequences.

AGAUAC, AGAUAG, AGAUAU, AGAUCC, AGAUCG, AGAUCU, AGAUGA, AGAUGC, AGAUGG, AGAUUA,

AGAUUC, AGAUUG, AGAUUU, AGCAAC, AGCACA, AGCACG, AGCACU, AGCAGA, AGCAUA, AGCAUC,

AGCAUG, AGCCAA, AGCCAU, AGCCCA, AGCCGA, AGCCGC, AGCCGG, AGCCGU, AGCCUA, AGCCUC,

AGCGAA, AGCGAG, AGCGAU, AGCGCA, AGCGCC, AGCGCG, AGCGCU, AGCGGA, AGCGGC, AGCGGU,

AGCGUA, AGCGUC, AGCGUG, AGCGUU, AGCUAA, AGCUAC, AGCUAG, AGCUAU, AGCUCA, AGCUCC,

AGCUCG, AGCUCU, AGCUGA, AGCUGG, AGCUGU, AGCUUC, AGCUUU, AGGAAU, AGGACC, AGGACG,

AGGAGA, AGGAGU, AGGAUA, AGGCAA, AGGCAU, AGGCCG, AGGCGA, AGGCGC, AGGCGG, AGGCUA,

AGGCUC, AGGCUU, AGGGAC, AGGGAU, AGGGGA, AGGGGU, AGGGUA, AGGGUG, AGGUAA,

AGGUAC, AGGUCA, AGGUCC, AGGUCU, AGGUGA, AGGUGC, AGGUGG, AGGUGU, AGGUUC,

AGGUUG, AGUAAA, AGUAAG, AGUAAU, AGUACA, AGUACG, AGUAGC, AGUAGG, AGUAUA, AGUAUC,

AGUAUG, AGUAUU, AGUCAA, AGUCAC, AGUCAG, AGUCAU, AGUCCA, AGUCCG, AGUCCU, AGUCGA,

AGUCGC, AGUCGG, AGUCGU, AGUCUA, AGUCUC, AGUCUG, AGUCUU, AGUGAA, AGUGAC, AGUGCG,

AGUGGG, AGUGUC, AGUUAA, AGUUAC, AGUUAG, AGUUCC, AGUUCG, AGUUGA, AGUUGC,

AGUUGU, AGUUUA, AGUUUC, AGUUUG, AGUUUU, AUAAAC, AUAAAU, AUAACA, AUAACC, AUAACG,

AUAACU, AUAAGA, AUAAGC, AUAAGG, AUAAGU, AUAAUC, AUAAUG, AUAAUU, AUACAC, AUACAG,

AUACAU, AUACCA, AUACCC, AUACCG, AUACGA, AUACGC, AUACGG, AUACGU, AUACUA, AUACUC,

AUACUG, AUACUU, AUAGAA, AUAGAC, AUAGAU, AUAGCA, AUAGCG, AUAGCU, AUAGGA, AUAGGU,

AUAGUA, AUAGUC, AUAGUG, AUAGUU, AUAUAC, AUAUAG, AUAUCC, AUAUCG, AUAUCU, AUAUGA,

AUAUGC, AUAUGG, AUAUGU, AUAUUC, AUAUUG, AUAUUU, AUCAAA, AUCAAC, AUCAAG, AUCAAU,

AUCACA, AUCACC, AUCACG, AUCAGC, AUCAGG, AUCCAA, AUCCAU, AUCCCC, AUCCCG, AUCCGA,

AUCCGC, AUCCGG, AUCCUA, AUCCUC, AUCCUG, AUCGAA, AUCGAC, AUCGAG, AUCGAU, AUCGCA,

AUCGCC, AUCGCG, AUCGCU, AUCGGC, AUCGGG, AUCGGU, AUCGUC, AUCGUG, AUCGUU, AUCUAA,

AUCUAC, AUCUAG, AUCUAU, AUCUCC, AUCUCG, AUCUGU, AUCUUG, AUCUUU, AUGAAA, AUGAAC,

AUGAAG, AUGAAU, AUGACC, AUGACU, AUGAGG, AUGAGU, AUGAUA, AUGAUC, AUGAUU, AUGCAA,

AUGCAG, AUGCCA, AUGCCC, AUGCCG, AUGCGA, AUGCGG, AUGCGU, AUGCUC, AUGCUU, AUGGAC,

AUGGCC, AUGGGA, AUGGGC, AUGGGU, AUGGUC, AUGGUG, AUGUAC, AUGUAU, AUGUCA,

AUGUCC, AUGUCG, AUGUGU, AUGUUA, AUGUUC, AUUAAA, AUUAAC, AUUAAG, AUUAAU, AUUACA,

AUUACC, AUUACG, AUUACU, AUUAGA, AUUAGC, AUUAGG, AUUAGU, AUUAUA, AUUAUC, AUUAUG,

AUUCAC, AUUCCA, AUUCCG, AUUCCU, AUUCGA, AUUCGC, AUUCGG, AUUCGU, AUUCUA, AUUCUC,

AUUCUU, AUUGAA, AUUGAC, AUUGAU, AUUGCC, AUUGCG, AUUGCU, AUUGGA, AUUGGC,

AUUGGG, AUUGGU, AUUGUA, AUUGUC, AUUGUG, AUUGUU, AUUUAA, AUUUAG, AUUUAU,

AUUUCC, AUUUCG, AUUUCU, AUUUGA, AUUUGC, AUUUGU, AUUUUA, AUUUUC, AUUUUG,

AUUUUU, CAAAAG, CAAACA, CAAACC, CAAACG, CAAACU, CAAAGA, CAAAGG, CAAAUA, CAAAUU,

CAACAC, CAACAU, CAACCA, CAACCC, CAACCG, CAACGA, CAACGC, CAACGG, CAACGU, CAACUA,

CAACUC, CAACUG, CAACUU, CAAGAA, CAAGAC, CAAGAU, CAAGCA, CAAGCC, CAAGCG, CAAGCU,

CAAGGA, CAAGGG, CAAGUC, CAAGUG, CAAGUU, CAAUAA, CAAUAC, CAAUAG, CAAUCC, CAAUCG,

CAAUCU, CAAUGA, CAAUGC, CAAUGG, CAAUGU, CAAUUC, CAAUUG, CAAUUU, CACAAU, CACACA,

CACACG, CACACU, CACAGA, CACAGC, CACAGG, CACAUA, CACAUC, CACAUU, CACCAA, CACCAC,

CACCAU, CACCCA, CACCCC, CACCCG, CACCGA, CACCGC, CACCGG, CACCGU, CACCUA, CACCUU,

TABLE 1 -continued

Non-Seed hexamer sequences.

CACGAA, CACGAC, CACGAG, CACGAU, CACGCA, CACGCC, CACGCU, CACGGA, CACGGC, CACGGG,
CACGGU, CACGUA, CACGUC, CACGUG, CACGUU, CACUAA, CACUAG, CACUAU, CACUCA, CACUCG,
CACUGA, CACUGC, CACUGG, CACUUA, CACUUC, CACUUU, CAGAAA, CAGAAG, CAGAAU, CAGACC,
CAGACG, CAGAGC, CAGAUA, CAGAUC, CAGCCG, CAGCCU, CAGCGA, CAGCGC, CAGCGG, CAGCGU,
CAGCUC, CAGCUU, CAGGAU, CAGGGG, CAGGGU, CAGGUA, CAGGUC, CAGGUU, CAGUAC, CAGUCG,
CAGUUG, CAUAAA, CAUAAC, CAUAAG, CAUAAU, CAUACA, CAUACC, CAUACG, CAUACU, CAUAGA,
CAUAGG, CAUAGU, CAUAUA, CAUAUC, CAUAUG, CAUCAA, CAUCAC, CAUCAG, CAUCAU, CAUCCA,
CAUCCC, CAUCCG, CAUCGA, CAUCGC, CAUCGG, CAUCGU, CAUCUA, CAUCUC, CAUCUG, CAUCUU,
CAUGAA, CAUGAC, CAUGAG, CAUGAU, CAUGCA, CAUGCC, CAUGCG, CAUGCU, CAUGGC, CAUGGG,
CAUGGU, CAUGUA, CAUGUC, CAUGUU, CAUUAA, CAUUAC, CAUUAG, CAUUCA, CAUUCC, CAUUCG,
CAUUCU, CAUUGA, CAUUGG, CAUUUC, CAUUUG, CAUUUU, CCAAAA, CCAAAC, CCAAAG, CCAAAU,
CCAACA, CCAACC, CCAACG, CCAACU, CCAAGA, CCAAGC, CCAAGG, CCAAUC, CCAAUG, CCAAUU,
CCACAA, CCACAC, CCACAG, CCACAU, CCACCA, CCACCC, CCACCG, CCACCU, CCACGA, CCACGC,
CCACGG, CCACGU, CCACUA, CCACUC, CCACUU, CCAGAA, CCAGAC, CCAGAG, CCAGCC, CCAGGU,
CCAGUC, CCAGUU, CCAUAA, CCAUAC, CCAUAG, CCAUAU, CCAUCA, CCAUCC, CCAUCU, CCAUGA,
CCAUGC, CCAUGG, CCAUUC, CCAUUG, CCAUUU, CCCAAC, CCCAAG, CCCAAU, CCCACA, CCCAGA,
CCCAGC, CCCAGU, CCCAUA, CCCAUC, CCCAUG, CCCAUU, CCCCAA, CCCCAG, CCCCAU, CCCCCC,
CCCCCG, CCCCCU, CCCCGA, CCCCGC, CCCCGU, CCCCUA, CCCCUC, CCCGAA, CCCGAC, CCCGAU,
CCCGCA, CCCGCU, CCCGGA, CCCGGC, CCCGUA, CCCGUG, CCCGUU, CCCUAA, CCCUAG, CCCUCA,
CCCUCU, CCCUGC, CCCUUA, CCCUUC, CCCUUU, CCGAAA, CCGAAC, CCGAAU, CCGACA, CCGACC,
CCGACG, CCGACU, CCGAGA, CCGAGG, CCGAGU, CCGAUA, CCGAUC, CCGAUG, CCGAUU, CCGCAA,
CCGCAC, CCGCAG, CCGCAU, CCGCCA, CCGCCC, CCGCCG, CCGCCU, CCGCGA, CCGCGC, CCGCGG,
CCGCGU, CCGCUA, CCGCUC, CCGCUG, CCGCUU, CCGGAA, CCGGAU, CCGGCA, CCGGCC, CCGGCG,
CCGGCU, CCGGGA, CCGGGC, CCGGGG, CCGGGU, CCGGUA, CCGGUC, CCGGUG, CCGUAA, CCGUAG,
CCGUAU, CCGUCA, CCGUCC, CCGUCG, CCGUGA, CCGUGU, CCGUUA, CCGUUC, CCGUUG, CCGUUU,
CCUAAC, CCUAAG, CCUAAU, CCUACA, CCUACC, CCUACG, CCUACU, CCUAGA, CCUAGC, CCUAGG,
CCUAGU, CCUAUA, CCUAUC, CCUAUG, CCUAUU, CCUCAA, CCUCAC, CCUCAG, CCUCAU, CCUCCA,
CCUCCC, CCUCCG, CCUCGA, CCUCGC, CCUCGG, CCUCGU, CCUCUA, CCUCUG, CCUGAC, CCUGAU,
CCUGCA, CCUGGG, CCUGGU, CCUGUU, CCUUAA, CCUUAC, CCUUAG, CCUUAU, CCUUCG, CCUUGA,
CCUUGU, CCUUUA, CCUUUC, CCUUUU, CGAAAA, CGAAAC, CGAAAG, CGAAAU, CGAACA, CGAACC,
CGAACG, CGAACU, CGAAGA, CGAAGC, CGAAGG, CGAAGU, CGAAUA, CGAAUC, CGAAUG, CGAAUU,
CGACAA, CGACAC, CGACAU, CGACCA, CGACCU, CGACGA, CGACGC, CGACGG, CGACGU, CGACUA,
CGACUG, CGACUU, CGAGAA, CGAGAC, CGAGAG, CGAGAU, CGAGCA, CGAGCC, CGAGCG, CGAGCU,
CGAGGC, CGAGGG, CGAGGU, CGAGUA, CGAGUC, CGAGUG, CGAGUU, CGAUAA, CGAUAC, CGAUAG,
CGAUAU, CGAUCA, CGAUCC, CGAUCG, CGAUCU, CGAUGA, CGAUGC, CGAUGG, CGAUGU, CGAUUA,
CGAUUC, CGAUUG, CGAUUU, CGCAAA, CGCAAC, CGCAAG, CGCAAU, CGCACA, CGCACC, CGCACG,
CGCAGA, CGCAGC, CGCAGG, CGCAGU, CGCAUA, CGCAUC, CGCAUG, CGCAUU, CGCCAA, CGCCAC,
CGCCAG, CGCCAU, CGCCCA, CGCCCC, CGCCCG, CGCCGA, CGCCGC, CGCCGG, CGCCGU, CGCCUA,
CGCCUG, CGCCUU, CGCGAA, CGCGAC, CGCGAG, CGCGAU, CGCGCA, CGCGCC, CGCGCG, CGCGCU,

TABLE 1 -continued

Non-Seed hexamer sequences.

CGCGGA, CGCGGC, CGCGGG, CGCGGU, CGCGUA, CGCGUC, CGCGUG, CGCGUU, CGCUAA, CGCUAC,
CGCUAG, CGCUAU, CGCUCA, CGCUCC, CGCUCG, CGCUCU, CGCUGA, CGCUGC, CGCUGG, CGCUGU,
CGCUUA, CGCUUC, CGCUUG, CGGAAA, CGGAAC, CGGAAG, CGGACA, CGGACC, CGGACG, CGGACU,
CGGAGC, CGGAGG, CGGAGU, CGGAUA, CGGAUU, CGGCAA, CGGCAC, CGGCAG, CGGCCA, CGGCCC,
CGGCCG, CGGCGC, CGGCGG, CGGCGU, CGGCUA, CGGCUC, CGGCUG, CGGCUU, CGGGAA, CGGGAC,
CGGGAG, CGGGAU, CGGGCA, CGGGCC, CGGGCG, CGGGCU, CGGGGU, CGGGUA, CGGGUC, CGGGUG,
CGGUAA, CGGUAC, CGGUAG, CGGUAU, CGGUCA, CGGUCG, CGGUCU, CGGUGA, CGGUGG, CGGUGU,
CGGUUA, CGGUUC, CGGUUG, CGGUUU, CGUAAA, CGUAAC, CGUAAG, CGUAAU, CGUACA, CGUACG,
CGUACU, CGUAGA, CGUAGC, CGUAGG, CGUAGU, CGUAUA, CGUAUC, CGUAUG, CGUAUU, CGUCAA,
CGUCAC, CGUCAG, CGUCAU, CGUCCA, CGUCCC, CGUCCG, CGUCCU, CGUCGA, CGUCGG, CGUCGU,
CGUCUA, CGUCUC, CGUCUG, CGUCUU, CGUGAA, CGUGAC, CGUGAG, CGUGAU, CGUGCC, CGUGCG,
CGUGCU, CGUGGA, CGUGGG, CGUGGU, CGUGUA, CGUGUG, CGUUAA, CGUUAC, CGUUAG,
CGUUAU, CGUUCA, CGUUCC, CGUUCG, CGUUCU, CGUUGA, CGUUGC, CGUUGU, CGUUUA, CGUUUC,
CGUUUU, CUAAAA, CUAAAC, CUAAAU, CUAACA, CUAACC, CUAACG, CUAACU, CUAAGA, CUAAGC,
CUAAGU, CUAAUA, CUAAUC, CUAAUG, CUACAC, CUACAU, CUACCA, CUACCC, CUACCG, CUACCU,
CUACGA, CUACGC, CUACGG, CUACGU, CUACUA, CUACUC, CUACUG, CUAGAA, CUAGAG, CUAGAU,
CUAGCA, CUAGCC, CUAGCG, CUAGCU, CUAGGA, CUAGGG, CUAGGU, CUAGUG, CUAGUU, CUAUAA,
CUAUAG, CUAUAU, CUAUCA, CUAUCC, CUAUCG, CUAUCU, CUAUGA, CUAUGC, CUAUGG, CUAUGU,
CUAUUA, CUAUUG, CUCAAC, CUCAAG, CUCAAU, CUCACC, CUCACG, CUCAGC, CUCAUA, CUCAUC,
CUCAUG, CUCAUU, CUCCAC, CUCCCC, CUCCCG, CUCCGA, CUCCGC, CUCCGG, CUCCUA, CUCCUC,
CUCCUU, CUCGAA, CUCGAC, CUCGAG, CUCGAU, CUCGCA, CUCGCC, CUCGCG, CUCGGG, CUCGGU,
CUCGUA, CUCGUC, CUCGUG, CUCGUU, CUCUAA, CUCUAC, CUCUAU, CUCUCA, CUCUCC, CUCUCU,
CUCUGC, CUCUGU, CUCUUA, CUCUUG, CUGAAG, CUGACC, CUGACG, CUGAGC, CUGAUA, CUGAUC,
CUGCCG, CUGCCU, CUGCGA, CUGCUA, CUGCUU, CUGGAG, CUGGAU, CUGGCG, CUGGGU, CUGUAC,
CUGUCA, CUGUCC, CUGUCG, CUGUGG, CUGUGU, CUGUUA, CUGUUU, CUUAAC, CUUAAG, CUUAAU,
CUUACC, CUUACG, CUUAGA, CUUAGC, CUUAGG, CUUAGU, CUUAUA, CUUAUC, CUUAUG, CUUAUU,
CUUCAG, CUUCAU, CUUCCA, CUUCCC, CUUCCG, CUUCCU, CUUCGA, CUUCGC, CUUCGG, CUUCGU,
CUUCUA, CUUGAC, CUUGAG, CUUGAU, CUUGCA, CUUGCC, CUUGCG, CUUGCU, CUUGGC, CUUGGU,
CUUGUU, CUUUAC, CUUUAG, CUUUAU, CUUUCA, CUUUCG, CUUUCU, CUUUGA, CUUUGC, CUUUGU,
CUUUUA, CUUUUC, CUUUUG, CUUUUU, GAAAAA, GAAAAG, GAAAAU, GAAACC, GAAACG, GAAAGA,
GAAAGC, GAAAGU, GAAAUA, GAAAUC, GAAAUG, GAAAUU, GAACAA, GAACAC, GAACAG, GAACAU,
GAACCA, GAACCC, GAACCG, GAACCU, GAACGA, GAACGC, GAACGG, GAACGU, GAACUA, GAACUG,
GAACUU, GAAGAC, GAAGAG, GAAGCA, GAAGCG, GAAGCU, GAAGUC, GAAUAA, GAAUAC, GAAUAG,
GAAUAU, GAAUCC, GAAUCG, GAAUCU, GAAUGA, GAAUGC, GAAUGU, GAAUUA, GAAUUC, GAAUUU,
GACAAA, GACAAG, GACAAU, GACACC, GACAGA, GACAGG, GACAUA, GACAUG, GACAUU, GACCAA,
GACCAC, GACCAG, GACCCA, GACCCC, GACCCG, GACCGC, GACCGG, GACCGU, GACCUA, GACCUC,
GACCUU, GACGAA, GACGAC, GACGAG, GACGAU, GACGCA, GACGCC, GACGCG, GACGCU, GACGGA,
GACGGC, GACGGG, GACGGU, GACGUA, GACGUC, GACGUG, GACGUU, GACUAA, GACUAC, GACUAG,
GACUAU, GACUCA, GACUCC, GACUCG, GACUGG, GACUGU, GACUUA, GACUUG, GACUUU, GAGAAU,

TABLE 1 -continued

Non-Seed hexamer sequences.

GAGAGA, GAGAGC, GAGAGG, GAGAUA, GAGAUC, GAGCAA, GAGCAU, GAGCCA, GAGCGA, GAGCGG,

GAGCGU, GAGGGU, GAGGUC, GAGGUG, GAGUAA, GAGUAG, GAGUCC, GAGUUC, GAGUUU,

GAUAAA, GAUAAC, GAUAAG, GAUAAU, GAUACA, GAUACC, GAUACG, GAUACU, GAUAGA, GAUAGC,

GAUAGG, GAUAGU, GAUAUA, GAUCAA, GAUCAC, GAUCAU, GAUCCA, GAUCCC, GAUCCU, GAUCGC,

GAUCGG, GAUCGU, GAUCUA, GAUCUG, GAUCUU, GAUGAA, GAUGAC, GAUGAG, GAUGCA, GAUGCC,

GAUGCG, GAUGCU, GAUGGC, GAUGGG, GAUGGU, GAUGUG, GAUGUU, GAUUAA, GAUUAC,

GAUUAG, GAUUAU, GAUUCA, GAUUCG, GAUUCU, GAUUGA, GAUUGC, GAUUUA, GAUUUC,

GAUUUG, GAUUUU, GCAAAC, GCAAAG, GCAAAU, GCAACA, GCAACC, GCAAGC, GCAAGU, GCAAUA,

GCAAUC, GCAAUG, GCAAUU, GCACAA, GCACAC, GCACAG, GCACCC, GCACCG, GCACCU, GCACGA,

GCACGC, GCACGU, GCACUA, GCACUC, GCACUG, GCACUU, GCAGAU, GCAGCC, GCAGCG, GCAGGC,

GCAGUA, GCAGUC, GCAGUG, GCAGUU, GCAUAA, GCAUAG, GCAUAU, GCAUCG, GCAUCU, GCAUGA,

GCAUGC, GCAUGG, GCAUGU, GCAUUA, GCAUUC, GCAUUG, GCAUUU, GCCAAA, GCCAAC, GCCAAU,

GCCACA, GCCACC, GCCACG, GCCAGA, GCCAGU, GCCAUA, GCCAUC, GCCAUG, GCCAUU, GCCCAA,

GCCCAC, GCCCAG, GCCCCG, GCCCGA, GCCCGG, GCCCGU, GCCGAA, GCCGAC, GCCGAG, GCCGAU,

GCCGCA, GCCGCU, GCCGGA, GCCGGC, GCCGGG, GCCGGU, GCCGUA, GCCGUC, GCCGUG, GCCGUU,

GCCUAA, GCCUAU, GCCUCA, GCCUCC, GCCUCG, GCCUGA, GCCUUA, GCCUUU, GCGAAA, GCGAAC,

GCGAAG, GCGAAU, GCGACC, GCGACG, GCGACU, GCGAGA, GCGAGC, GCGAGG, GCGAGU, GCGAUA,

GCGAUC, GCGAUG, GCGAUU, GCGCAA, GCGCAC, GCGCAG, GCGCAU, GCGCCA, GCGCCC, GCGCCU,

GCGCGA, GCGCGU, GCGCUA, GCGCUC, GCGCUG, GCGCUU, GCGGAA, GCGGAC, GCGGAU, GCGGCA,

GCGGCC, GCGGCU, GCGGGA, GCGGUA, GCGGUC, GCGGUU, GCGUAA, GCGUAC, GCGUAG, GCGUAU,

GCGUCA, GCGUCC, GCGUCG, GCGUCU, GCGUGA, GCGUGC, GCGUGG, GCGUGU, GCGUUA, GCGUUC,

GCGUUG, GCGUUU, GCUAAA, GCUAAC, GCUAAG, GCUAAU, GCUACC, GCUACG, GCUACU, GCUAGA,

GCUAGG, GCUAGU, GCUAUA, GCUAUC, GCUAUU, GCUCAA, GCUCAC, GCUCAG, GCUCAU, GCUCCA,

GCUCCC, GCUCCG, GCUCGA, GCUCGC, GCUCGU, GCUCUA, GCUCUC, GCUCUU, GCUGAA, GCUGAC,

GCUGAU, GCUGCA, GCUGCC, GCUGCG, GCUGCU, GCUGUG, GCUGUU, GCUUAC, GCUUAG, GCUUAU,

GCUUCA, GCUUCG, GCUUGA, GCUUGG, GCUUGU, GCUUUA, GCUUUG, GGAAAG, GGAACA, GGAACC,

GGAACG, GGAACU, GGAAGU, GGAAUA, GGAAUC, GGAAUU, GGACAA, GGACAC, GGACAG, GGACAU,

GGACCG, GGACGA, GGACGC, GGACGU, GGACUA, GGACUC, GGACUU, GGAGAC, GGAGCA, GGAGCG,

GGAGGG, GGAGUA, GGAUAA, GGAUAC, GGAUCA, GGAUCC, GGAUCG, GGAUCU, GGAUGC, GGAUUA,

GGAUUG, GGCAAU, GGCACA, GGCACU, GGCAGA, GGCAUA, GGCAUC, GGCCAC, GGCCAG, GGCCCC,

GGCCGA, GGCCGC, GGCCGU, GGCCUA, GGCCUG, GGCCUU, GGCGAA, GGCGAG, GGCGAU, GGCGCA,

GGCGCU, GGCGGU, GGCGUA, GGCGUC, GGCGUG, GGCGUU, GGCUAA, GGCUAC, GGCUAG, GGCUAU,

GGCUCC, GGCUCG, GGCUGA, GGCUUA, GGCUUC, GGCUUG, GGGAAU, GGGACA, GGGAGA, GGGAGU,

GGGAUA, GGGAUU, GGGCAA, GGGCAC, GGGCAG, GGGCCG, GGGCGG, GGGGCC, GGGGGG,

GGGGGU, GGGGUA, GGGUAC, GGGUAU, GGGUCA, GGGUCC, GGGUCG, GGGUGA, GGGUGC,

GGGUUA, GGGUUG, GGUAAA, GGUAAC, GGUAAG, GGUAAU, GGUACA, GGUACC, GGUACG,

GGUACU, GGUAGC, GGUAGG, GGUAGU, GGUAUA, GGUAUC, GGUAUG, GGUCAA, GGUCAC,

GGUCAG, GGUCAU, GGUCCA, GGUCCG, GGUCCU, GGUCGA, GGUCGC, GGUCGG, GGUCGU, GGUCUC,

GGUCUU, GGUGAA, GGUGAC, GGUGAU, GGUGCA, GGUGCC, GGUGGC, GGUGUA, GGUGUC,

TABLE 1 -continued

Non-Seed hexamer sequences.

GGUUAA, GGUUAG, GGUUAU, GGUUCA, GGUUCC, GGUUCG, GGUUGC, GGUUUC, GGUUUU,

GUAAAA, GUAAAG, GUAAAU, GUAACC, GUAACG, GUAACU, GUAAGA, GUAAGC, GUAAGG, GUAAGU,

GUAAUA, GUAAUC, GUAAUG, GUAAUU, GUACAA, GUACAC, GUACAG, GUACAU, GUACCA, GUACCC,

GUACCG, GUACCU, GUACGA, GUACGC, GUACGG, GUACGU, GUACUA, GUACUC, GUACUG, GUACUU,

GUAGAA, GUAGAC, GUAGCA, GUAGCC, GUAGCG, GUAGCU, GUAGGA, GUAGGC, GUAGGG,

GUAGGU, GUAGUA, GUAGUC, GUAUAA, GUAUAC, GUAUAG, GUAUAU, GUAUCA, GUAUCG,

GUAUCU, GUAUGA, GUAUGC, GUAUGG, GUAUUA, GUAUUG, GUAUUU, GUCAAA, GUCAAG,

GUCAAU, GUCACA, GUCACC, GUCACG, GUCAGA, GUCAGC, GUCAGG, GUCAUA, GUCAUC, GUCAUG,

GUCCAA, GUCCAC, GUCCAU, GUCCCC, GUCCCU, GUCCGA, GUCCGC, GUCCGG, GUCCGU, GUCCUA,

GUCCUG, GUCCUU, GUCGAA, GUCGAC, GUCGAG, GUCGAU, GUCGCA, GUCGCC, GUCGCG, GUCGCU,

GUCGGA, GUCGGC, GUCGGG, GUCGGU, GUCGUA, GUCGUC, GUCGUU, GUCUAA, GUCUAG, GUCUCA,

GUCUCC, GUCUCG, GUCUGA, GUCUGG, GUCUGU, GUCUUC, GUCUUU, GUGAAA, GUGAAC, GUGAAG,

GUGACC, GUGACG, GUGAGA, GUGAGC, GUGAGU, GUGAUC, GUGAUG, GUGAUU, GUGCAC,

GUGCAU, GUGCCC, GUGCCG, GUGCGA, GUGCGG, GUGCGU, GUGCUA, GUGCUC, GUGCUG,

GUGGAG, GUGGCG, GUGGCU, GUGGGU, GUGGUC, GUGGUG, GUGUAA, GUGUAG, GUGUCG,

GUGUGA, GUGUGC, GUGUGU, GUGUUG, GUGUUU, GUUAAA, GUUAAC, GUUAAG, GUUACA,

GUUACC, GUUACG, GUUACU, GUUAGA, GUUAGC, GUUAGU, GUUAUA, GUUAUC, GUUAUG,

GUUAUU, GUUCAA, GUUCAC, GUUCAG, GUUCCA, GUUCCG, GUUCGA, GUUCGC, GUUCGG, GUUCGU,

GUUCUA, GUUCUG, GUUGAA, GUUGAC, GUUGAG, GUUGAU, GUUGCG, GUUGCU, GUUGGA,

GUUGGC, GUUGGU, GUUGUC, GUUGUG, GUUGUU, GUUUAA, GUUUAC, GUUUAG, GUUUAU,

GUUUCA, GUUUCC, GUUUCU, GUUUGA, GUUUGC, GUUUGG, GUUUGU, GUUUUA, GUUUUC,

GUUUUU, UAAAAA, UAAAAC, UAAAAG, UAAAAU, UAAACA, UAAACC, UAAACG, UAAACU, UAAAGA,

UAAAGG, UAAAGU, UAAAUA, UAAAUC, UAAAUG, UAAAUU, UAACAA, UAACAC, UAACAG, UAACCA,

UAACCC, UAACCG, UAACCU, UAACGA, UAACGC, UAACGG, UAACGU, UAACUA, UAACUG, UAACUU,

UAAGAG, UAAGAU, UAAGCA, UAAGCC, UAAGCG, UAAGCU, UAAGGA, UAAGGC, UAAGGG, UAAGGU,

UAAGUA, UAAGUC, UAAGUG, UAAGUU, UAAUAA, UAAUCA, UAAUCC, UAAUCG, UAAUCU, UAAUGA,

UAAUGG, UAAUGU, UAAUUA, UAAUUC, UAAUUG, UACAAC, UACAAG, UACAAU, UACACC, UACACG,

UACACU, UACAGA, UACAGC, UACAUA, UACAUC, UACAUU, UACCAA, UACCAC, UACCAG, UACCAU,

UACCCC, UACCCG, UACCCU, UACCGA, UACCGC, UACCGG, UACCGU, UACCUA, UACCUG, UACGAA,

UACGAC, UACGAG, UACGAU, UACGCA, UACGCC, UACGCG, UACGCU, UACGGC, UACGGG, UACGGU,

UACGUA, UACGUC, UACGUG, UACGUU, UACUAA, UACUAC, UACUAG, UACUAU, UACUCA, UACUCC,

UACUCG, UACUCU, UACUGA, UACUGC, UACUGG, UACUUA, UACUUG, UACUUU, UAGAAA, UAGAAG,

UAGAAU, UAGACA, UAGACG, UAGAGA, UAGAGC, UAGAGU, UAGAUA, UAGAUC, UAGAUG, UAGCAU,

UAGCCC, UAGCCG, UAGCCU, UAGCGA, UAGCGC, UAGCGU, UAGCUA, UAGCUC, UAGCUG, UAGGAA,

UAGGAU, UAGGCG, UAGGCU, UAGGGU, UAGGUC, UAGGUG, UAGGUU, UAGUAA, UAGUAC,

UAGUAG, UAGUAU, UAGUCA, UAGUCG, UAGUGU, UAGUUA, UAGUUC, UAGUUG, UAGUUU,

UAUAAC, UAUAAG, UAUACU, UAUAGA, UAUAGC, UAUAGG, UAUAGU, UAUAUA, UAUAUC, UAUAUG,

UAUAUU, UAUCAA, UAUCAC, UAUCAU, UAUCCA, UAUCCC, UAUCCG, UAUCCU, UAUCGA, UAUCGC,

UAUCGG, UAUCGU, UAUCUA, UAUCUC, UAUCUG, UAUCUU, UAUGAA, UAUGAC, UAUGAG,

TABLE 1 -continued

Non-Seed hexamer sequences.

UAUGAU, UAUGCA, UAUGCG, UAUGCU, UAUGGA, UAUGGC, UAUGUC, UAUGUG, UAUGUU,

UAUUAG, UAUUCA, UAUUCC, UAUUCG, UAUUCU, UAUUGA, UAUUGG, UAUUUA, UAUUUC,

UAUUUG, UAUUUU, UCAAAA, UCAAAC, UCAAAG, UCAACC, UCAACU, UCAAGA, UCAAGC, UCAAUA,

UCAAUC, UCAAUG, UCAAUU, UCACCC, UCACCG, UCACCU, UCACGA, UCACGC, UCACGG, UCACGU,

UCACUA, UCACUC, UCACUU, UCAGAA, UCAGAC, UCAGAG, UCAGCG, UCAGCU, UCAGGA, UCAGGC,

UCAGGU, UCAGUC, UCAGUU, UCAUAA, UCAUCA, UCAUCC, UCAUCG, UCAUGC, UCAUGG, UCAUGU,

UCAUUA, UCAUUG, UCCAAA, UCCAAC, UCCAAG, UCCAAU, UCCACA, UCCACC, UCCACG, UCCAGC,

UCCAGG, UCCAUA, UCCAUC, UCCAUU, UCCCAA, UCCCAG, UCCCAU, UCCCCC, UCCCCG, UCCCCU,

UCCCGA, UCCCGC, UCCCGG, UCCCGU, UCCCUA, UCCCUC, UCCGAA, UCCGAC, UCCGAG, UCCGAU,

UCCGCA, UCCGCC, UCCGGA, UCCGGC, UCCGGU, UCCGUA, UCCGUC, UCCGUG, UCCUAA, UCCUCA,

UCCUCG, UCCUCU, UCCUGC, UCCUGU, UCCUUA, UCCUUC, UCCUUU, UCGAAA, UCGAAC, UCGAAG,

UCGAAU, UCGACA, UCGACC, UCGACG, UCGACU, UCGAGA, UCGAGC, UCGAGG, UCGAUA, UCGAUC,

UCGAUG, UCGAUU, UCGCAA, UCGCAC, UCGCAG, UCGCAU, UCGCCA, UCGCCC, UCGCCG, UCGCCU,

UCGCGA, UCGCGC, UCGCGU, UCGCUA, UCGCUC, UCGGAA, UCGGAC, UCGGAG, UCGGAU, UCGGCA,

UCGGCU, UCGGGG, UCGGGU, UCGGUC, UCGGUG, UCGGUU, UCGUAA, UCGUAC, UCGUAG,

UCGUAU, UCGUCA, UCGUCC, UCGUCG, UCGUCU, UCGUGA, UCGUGU, UCGUUA, UCGUUC, UCGUUG,

UCGUUU, UCUAAC, UCUAAG, UCUAAU, UCUACA, UCUACC, UCUACG, UCUACU, UCUAGC, UCUAGG,

UCUAGU, UCUAUA, UCUAUC, UCUAUG, UCUAUU, UCUCAG, UCUCAU, UCUCCG, UCUCGC, UCUCGG,

UCUCGU, UCUCUC, UCUGAA, UCUGAU, UCUGCA, UCUGCG, UCUGCU, UCUGGC, UCUGGU, UCUGUC,

UCUGUG, UCUGUU, UCUUAA, UCUUAC, UCUUAG, UCUUAU, UCUUCA, UCUUCC, UCUUCG, UCUUCU,

UCUUGC, UCUUGG, UCUUGU, UCUUUA, UCUUUC, UCUUUG, UCUUUU, UGAAAA, UGAAAC,

UGAACA, UGAACC, UGAAGG, UGAAUC, UGAAUG, UGACAA, UGACAC, UGACAG, UGACCA, UGACCC,

UGACCG, UGACGA, UGACGC, UGACGG, UGACGU, UGACUA, UGACUC, UGACUU, UGAGAG, UGAGAU,

UGAGCA, UGAGCC, UGAGCU, UGAGGC, UGAGGU, UGAGUA, UGAGUU, UGAUAC, UGAUAG,

UGAUAU, UGAUCA, UGAUCG, UGAUCU, UGAUGA, UGAUGC, UGAUGG, UGAUGU, UGAUUA,

UGAUUC, UGAUUG, UGAUUU, UGCAAC, UGCAAG, UGCACA, UGCACG, UGCAGG, UGCAGU, UGCAUC,

UGCCCA, UGCCCC, UGCCCG, UGCCGA, UGCCGC, UGCCGG, UGCCGU, UGCCUA, UGCCUC, UGCCUG,

UGCCUU, UGCGAA, UGCGAC, UGCGAU, UGCGCC, UGCGCG, UGCGCU, UGCGGC, UGCGGG, UGCGGU,

UGCGUA, UGCGUC, UGCGUG, UGCGUU, UGCUAC, UGCUAU, UGCUCC, UGCUCG, UGCUGC, UGCUGG,

UGCUGU, UGCUUA, UGCUUU, UGGAAC, UGGAAG, UGGAGC, UGGAUC, UGGAUU, UGGCAA,

UGGCAC, UGGCAG, UGGCCG, UGGCCU, UGGCGA, UGGCGC, UGGCGU, UGGCUA, UGGCUC, UGGCUU,

UGGGAA, UGGGCA, UGGGCC, UGGGGC, UGGGUC, UGGUAA, UGGUAG, UGGUAU, UGGUCC,

UGGUCG, UGGUCU, UGGUGA, UGGUGC, UGGUGG, UGGUGU, UGGUUA, UGGUUG, UGUAAA,

UGUAAC, UGUAAG, UGUACC, UGUACG, UGUACU, UGUAGA, UGUAGC, UGUAGU, UGUAUC,

UGUAUU, UGUCAA, UGUCAC, UGUCAG, UGUCAU, UGUCCA, UGUCCC, UGUCCG, UGUCGA, UGUCGC,

UGUCGG, UGUCGU, UGUCUA, UGUCUC, UGUGAC, UGUGAG, UGUGAU, UGUGCA, UGUGGU,

UGUGUA, UGUGUU, UGUUAC, UGUUAG, UGUUAU, UGUUCA, UGUUCC, UGUUCG, UGUUGG,

UGUUGU, UGUUUA, UGUUUC, UGUUUG, UGUUUU, UUAAAA, UUAAAC, UUAAAG, UUAAAU,

UUAACC, UUAACG, UUAACU, UUAAGU, UUAAUA, UUAAUC, UUAAUG, UUAAUU, UUACAA, UUACAC,

TABLE 1 -continued

Non-Seed hexamer sequences.

UUACAG, UUACAU, UUACCA, UUACCC, UUACCG, UUACCU, UUACGA, UUACGC, UUACGG, UUACGU,

UUACUA, UUACUC, UUACUG, UUACUU, UUAGAA, UUAGAC, UUAGCC, UUAGCG, UUAGCU, UUAGGC,

UUAGGU, UUAGUA, UUAGUC, UUAGUU, UUAUAA, UUAUAC, UUAUAG, UUAUAU, UUAUCC,

UUAUCG, UUAUCU, UUAUGA, UUAUGG, UUAUGU, UUAUUA, UUAUUC, UUAUUG, UUAUUU,

UUCAAC, UUCAAU, UUCACA, UUCACC, UUCACG, UUCACU, UUCAGC, UUCAGG, UUCAGU, UUCAUA,

UUCAUC, UUCAUG, UUCAUU, UUCCAA, UUCCCA, UUCCCG, UUCCGA, UUCCGU, UUCCUU, UUCGAA,

UUCGAC, UUCGAG, UUCGAU, UUCGCA, UUCGCC, UUCGCG, UUCGCU, UUCGGA, UUCGGC, UUCGGG,

UUCGGU, UUCGUA, UUCGUC, UUCGUG, UUCGUU, UUCUAC, UUCUAG, UUCUCA, UUCUCG,

UUCUGG, UUCUUA, UUCUUU, UUGAAA, UUGAAC, UUGAAG, UUGAAU, UUGACC, UUGACG,

UUGACU, UUGAGA, UUGAGC, UUGAGU, UUGAUA, UUGAUC, UUGAUG, UUGAUU, UUGCAA,

UUGCAC, UUGCAG, UUGCAU, UUGCCC, UUGCCG, UUGCGA, UUGCGC, UUGCGG, UUGCGU, UUGCUA,

UUGCUC, UUGCUG, UUGCUU, UUGGAA, UUGGAG, UUGGCC, UUGGCG, UUGGCU, UUGGGC,

UUGGGU, UUGGUA, UUGGUG, UUGUAA, UUGUAC, UUGUCA, UUGUCG, UUGUCU, UUGUGC,

UUGUGG, UUGUUA, UUGUUG, UUGUUU, UUUAAA, UUUAAC, UUUAAG, UUUAAU, UUUACA,

UUUACC, UUUACG, UUUACU, UUUAGA, UUUAGC, UUUAGG, UUUAGU, UUUAUA, UUUAUC,

UUUAUG, UUUAUU, UUUCAU, UUUCCA, UUUCCG, UUUCCU, UUUCGA, UUUCGC, UUUCGG,

UUUCGU, UUUCUA, UUUCUC, UUUCUG, UUUCUU, UUUGAA, UUUGAC, UUUGAG, UUUGAU,

UUUGCC, UUUGCU, UUUGGA, UUUGGC, UUUGGG, UUUGGU, UUUGUA, UUUGUC, UUUGUU,

UUUUAA, UUUUAG, UUUUAU, UUUUCC, UUUUCG, UUUUCU, UUUUGA, UUUUGC, UUUUGG,

UUUUGU, UUUUUA, UUUUUC, UUUUUU

TABLE 2

Oligonucleotide sequences made for testing

| Oligo Name | RQ | RQ SE | Gene Name | Expt Type | Cell Line/Tissue | [Oligo] | Assay Type | Coordinates_g |
|---|---|---|---|---|---|---|---|---|
| SMN1-01 | 0.812671952 | 0.135251351 | SMN1 | in vitro | RPTEC | 100 | qRTPCR | SMN1:21157U20 |
| SMN1-01 | 0.857032101 | 0.027318737 | SMN1 | in vitro | RPTEC | 50 | qRTPCR | SMN1:21157U20 |
| SMN1-01 | 0.167998915 | 0.167998672 | SMN1 | in vitro | Hep3B | 50 | qRTPCR | SMN1:21157U20 |
| SMN1-01 | 1.048125302 | 0.039302784 | SMN1 | in vitro | Hep3B | 100 | qRTPCR | SMN1:21157U20 |
| SMN1-01 | 1.381704207 | 0.053290565 | SMN1 | in vitro | Hep3B | 10 | qRTPCR | SMN1:21157U20 |
| SMN1-01 | 0.979869247 | 0.020515227 | SMN1 | in vitro | Hep3B | 30 | qRTPCR | SMN1:21157U20 |
| SMN1-02 | 0.760000318 | 0.042993212 | SMN1 | in vitro | RPTEC | 100 | qRTPCR | SMN1:21158U20 |
| SMN1-02 | 0.987138447 | 0.068187998 | SMN1 | in vitro | RPTEC | 50 | qRTPCR | SMN1:21158U20 |
| SMN1-02 | 2.252494526 | 1.803190669 | SMN1 | in vitro | Hep3B | 50 | qRTPCR | SMN1:21158U20 |
| SMN1-02 | 1.114387973 | 0.026733251 | SMN1 | in vitro | Hep3B | 100 | qRTPCR | SMN1:21158U20 |
| SMN1-02 | 1.34641929 | 0.027641281 | SMN1 | in vitro | Hep3B | 10 | qRTPCR | SMN1:21158U20 |
| SMN1-02 | 1.153697083 | 0.024999991 | SMN1 | in vitro | Hep3B | 30 | qRTPCR | SMN1:21158U20 |
| SMN1-03 | 1.90722975 | 0.525939296 | SMN1 | in vitro | RPTEC | 100 | qRTPCR | SMN1:21159U20 |
| SMN1-03 | 1.132758264 | 0.094640177 | SMN1 | in vitro | RPTEC | 50 | qRTPCR | SMN1:21159U20 |
| SMN1-03 | 0.29619174 | 0.173282309 | SMN1 | in vitro | Hep3B | 50 | qRTPCR | SMN1:21159U20 |
| SMN1-03 | 1.48817935 | 0.172719507 | SMN1 | in vitro | Hep3B | 100 | qRTPCR | SMN1:21159U20 |
| SMN1-03 | 1.29932826 | 0.059825228 | SMN1 | in vitro | Hep3B | 10 | qRTPCR | SMN1:21159U20 |
| SMN1-03 | 1.511567814 | 0.054178175 | SMN1 | in vitro | Hep3B | 30 | qRTPCR | SMN1:21159U20 |
| SMN1-04 | 1.048306517 | 0.243934543 | SMN1 | in vitro | RPTEC | 100 | qRTPCR | SMN1:21160U20 |
| SMN1-04 | 1.322407267 | 0.100022392 | SMN1 | in vitro | RPTEC | 50 | qRTPCR | SMN1:21160U20 |
| SMN1-04 | 0.133170013 | 0.032824391 | SMN1 | in vitro | Hep3B | 50 | qRTPCR | SMN1:21160U20 |
| SMN1-04 | 1.289550163 | 0.330195987 | SMN1 | in vitro | Hep3B | 100 | qRTPCR | SMN1:21160U20 |
| SMN1-04 | 1.280225492 | 0.062577972 | SMN1 | in vitro | Hep3B | 10 | qRTPCR | SMN1:21160U20 |
| SMN1-04 | 1.488482795 | 0.044641287 | SMN1 | in vitro | Hep3B | 30 | qRTPCR | SMN1:21160U20 |
| SMN1-05 | 0.876747527 | 0.087392504 | SMN1 | in vitro | RPTEC | 100 | qRTPCR | SMN1:21161U20 |
| SMN1-05 | 1.167120345 | 0.069814091 | SMN1 | in vitro | RPTEC | 50 | qRTPCR | SMN1:21161U20 |
| SMN1-05 | 0.088317863 | 0.039887014 | SMN1 | in vitro | Hep3B | 50 | qRTPCR | SMN1:21161U20 |

TABLE 2-continued

Oligonucleotide sequences made for testing

| Oligo Name | RQ | RQ SE | Gene Name | Expt Type | Cell Line/Tissue | [Oligo] | Assay Type | Coordinates_g |
|---|---|---|---|---|---|---|---|---|
| SMN1-05 | 1.310053256 | 0.234231348 | SMN1 | in vitro | Hep3B | 100 | qRTPCR | SMN1:21161U20 |
| SMN1-05 | 1.038699643 | 0.056421362 | SMN1 | in vitro | Hep3B | 10 | qRTPCR | SMN1:21161U20 |
| SMN1-05 | 0.859144751 | 0.039970015 | SMN1 | in vitro | Hep3B | 30 | qRTPCR | SMN1:21161U20 |
| SMN1-06 | 0.704659891 | 0.087244119 | SMN1 | in vitro | RPTEC | 100 | qRTPCR | SMN1:21162U20 |
| SMN1-06 | 1.11194006 | 0.088571377 | SMN1 | in vitro | RPTEC | 50 | qRTPCR | SMN1:21162U20 |
| SMN1-06 | 0.57685962 | 0.246186541 | SMN1 | in vitro | Hep3B | 50 | qRTPCR | SMN1:21162U20 |
| SMN1-06 | 1.419418884 | 0.432447122 | SMN1 | in vitro | Hep3B | 100 | qRTPCR | SMN1:21162U20 |
| SMN1-06 | 1.146251704 | 0.051891541 | SMN1 | in vitro | Hep3B | 10 | qRTPCR | SMN1:21162U20 |
| SMN1-06 | 1.030682317 | 0.013070835 | SMN1 | in vitro | Hep3B | 30 | qRTPCR | SMN1:21162U20 |
| SMN1-07 | 0.682085732 | 0.084885351 | SMN1 | in vitro | RPTEC | 100 | qRTPCR | SMN1:21163U20 |
| SMN1-07 | 0.975853552 | 0.034178542 | SMN1 | in vitro | RPTEC | 50 | qRTPCR | SMN1:21163U20 |
| SMN1-07 | 1.013252314 | 0.118540759 | SMN1 | in vitro | Hep3B | 50 | qRTPCR | SMN1:21163U20 |
| SMN1-07 | 1.039381902 | 0.059815387 | SMN1 | in vitro | Hep3B | 100 | qRTPCR | SMN1:21163U20 |
| SMN1-07 | 1.156949605 | 0.107385405 | SMN1 | in vitro | Hep3B | 10 | qRTPCR | SMN1:21163U20 |
| SMN1-07 | 1.239503954 | 0.134603844 | SMN1 | in vitro | Hep3B | 30 | qRTPCR | SMN1:21163U20 |
| SMN1-08 | 0.948714888 | 0.142708231 | SMN1 | in vitro | RPTEC | 100 | qRTPCR | SMN1:21164U20 |
| SMN1-08 | 1.312080445 | 0.058464993 | SMN1 | in vitro | RPTEC | 50 | qRTPCR | SMN1:21164U20 |
| SMN1-08 | 0.216530007 | 0.177400555 | SMN1 | in vitro | Hep3B | 50 | qRTPCR | SMN1:21164U20 |
| SMN1-08 | 2.082151781 | 0.815184252 | SMN1 | in vitro | Hep3B | 100 | qRTPCR | SMN1:21164U20 |
| SMN1-08 | 1.010090604 | 0.200588791 | SMN1 | in vitro | Hep3B | 10 | qRTPCR | SMN1:21164U20 |
| SMN1-08 | 1.223947667 | 0.295307243 | SMN1 | in vitro | Hep3B | 30 | qRTPCR | SMN1:21164U20 |
| SMN1-09 | 0.77519063 | 0.098695118 | SMN1 | in vitro | RPTEC | 100 | qRTPCR | SMN1:21165U20 |
| SMN1-09 | 1.685731616 | 0.014884028 | SMN1 | in vitro | RPTEC | 50 | qRTPCR | SMN1:21165U20 |
| SMN1-09 | 0.621406781 | 0.227211261 | SMN1 | in vitro | Hep3B | 50 | qRTPCR | SMN1:21165U20 |
| SMN1-09 | 0.85593922 | 0.256108337 | SMN1 | in vitro | Hep3B | 100 | qRTPCR | SMN1:21165U20 |
| SMN1-09 | 0.940186097 | 0.197008464 | SMN1 | in vitro | Hep3B | 10 | qRTPCR | SMN1:21165U20 |
| SMN1-09 | 0.864481145 | 0.162739271 | SMN1 | in vitro | Hep3B | 30 | qRTPCR | SMN1:21165U20 |
| SMN1-10 | 0.945730986 | 0.08072952 | SMN1 | in vitro | RPTEC | 100 | qRTPCR | SMN1:21166U20 |
| SMN1-10 | 1.574526902 | 0.123062684 | SMN1 | in vitro | RPTEC | 50 | qRTPCR | SMN1:21166U20 |
| SMN1-10 | 0.482822242 | 0.131557474 | SMN1 | in vitro | Hep3B | 50 | qRTPCR | SMN1:21166U20 |
| SMN1-10 | 1.280629128 | 0.17088425 | SMN1 | in vitro | Hep3B | 100 | qRTPCR | SMN1:21166U20 |
| SMN1-10 | 1.127254654 | 0.152486374 | SMN1 | in vitro | Hep3B | 10 | qRTPCR | SMN1:21166U20 |
| SMN1-10 | 1.069571458 | 0.122106758 | SMN1 | in vitro | Hep3B | 30 | qRTPCR | SMN1:21166U20 |
| SMN1-11 | 0.774436979 | 0.038076182 | SMN1 | in vitro | RPTEC | 100 | qRTPCR | SMN1:21167U20 |
| SMN1-11 | 1.562714254 | 0.158043098 | SMN1 | in vitro | RPTEC | 50 | qRTPCR | SMN1:21167U20 |
| SMN1-11 | 0.463655938 | 0.295513886 | SMN1 | in vitro | Hep3B | 50 | qRTPCR | SMN1:21167U20 |
| SMN1-11 | 0.957611652 | 0.334137541 | SMN1 | in vitro | Hep3B | 100 | qRTPCR | SMN1:21167U20 |
| SMN1-11 | 1.225973818 | 0.223472758 | SMN1 | in vitro | Hep3B | 10 | qRTPCR | SMN1:21167U20 |
| SMN1-11 | 1.089302259 | 0.126414268 | SMN1 | in vitro | Hep3B | 30 | qRTPCR | SMN1:21167U20 |
| SMN1-12 | 0.981429476 | 0.07937384 | SMN1 | in vitro | RPTEC | 100 | qRTPCR | SMN1:21168U20 |
| SMN1-12 | 1.585088128 | 0.05291912 | SMN1 | in vitro | RPTEC | 50 | qRTPCR | SMN1:21168U20 |
| SMN1-12 | 0.208586047 | 0.187017655 | SMN1 | in vitro | Hep3B | 50 | qRTPCR | SMN1:21168U20 |
| SMN1-12 | 3.266965896 | 2.002074369 | SMN1 | in vitro | Hep3B | 100 | qRTPCR | SMN1:21168U20 |
| SMN1-12 | 1.03381379 | 0.204376291 | SMN1 | in vitro | Hep3B | 10 | qRTPCR | SMN1:21168U20 |
| SMN1-12 | 1.137471671 | 0.246791954 | SMN1 | in vitro | Hep3B | 30 | qRTPCR | SMN1:21168U20 |
| SMN1-13 | 0.749636437 | 0.103277003 | SMN1 | in vitro | RPTEC | 100 | qRTPCR | SMN1:21169U20 |
| SMN1-13 | 1.175989263 | 0.122355585 | SMN1 | in vitro | RPTEC | 50 | qRTPCR | SMN1:21169U20 |
| SMN1-13 | 0.161499159 | 0.079356287 | SMN1 | in vitro | Hep3B | 50 | qRTPCR | SMN1:21169U20 |
| SMN1-13 | 1.287763591 | 0.090306717 | SMN1 | in vitro | Hep3B | 100 | qRTPCR | SMN1:21169U20 |
| SMN1-13 | 1.3368516 | 0.177814975 | SMN1 | in vitro | Hep3B | 10 | qRTPCR | SMN1:21169U20 |
| SMN1-13 | 1.037772291 | 0.039404507 | SMN1 | in vitro | Hep3B | 30 | qRTPCR | SMN1:21169U20 |
| SMN1-14 | 0.771635177 | 0.086041959 | SMN1 | in vitro | RPTEC | 100 | qRTPCR | SMN1:21170U20 |
| SMN1-14 | 1.467048548 | 0.073113884 | SMN1 | in vitro | RPTEC | 50 | qRTPCR | SMN1:21170U20 |
| SMN1-14 | 1.978254154 | 1.352951156 | SMN1 | in vitro | Hep3B | 50 | qRTPCR | SMN1:21170U20 |
| SMN1-14 | 1.311990937 | 0.073121634 | SMN1 | in vitro | Hep3B | 100 | qRTPCR | SMN1:21170U20 |
| SMN1-14 | 1.12892777 | 0.147162701 | SMN1 | in vitro | Hep3B | 10 | qRTPCR | SMN1:21170U20 |
| SMN1-14 | 0.855795121 | 0.017797181 | SMN1 | in vitro | Hep3B | 30 | qRTPCR | SMN1:21170U20 |
| SMN1-15 | 0.891491964 | 0.039822032 | SMN1 | in vitro | RPTEC | 100 | qRTPCR | SMN1:21171U20 |
| SMN1-15 | 1.573440342 | 0.117453017 | SMN1 | in vitro | RPTEC | 50 | qRTPCR | SMN1:21171U20 |
| SMN1-15 | 0.366043104 | 0.117162019 | SMN1 | in vitro | Hep3B | 50 | qRTPCR | SMN1:21171U20 |
| SMN1-15 | 1.738217394 | 0.520148155 | SMN1 | in vitro | Hep3B | 100 | qRTPCR | SMN1:21171U20 |
| SMN1-15 | 1.383201337 | 0.101830776 | SMN1 | in vitro | Hep3B | 10 | qRTPCR | SMN1:21171U20 |
| SMN1-15 | 1.619495052 | 0.038364989 | SMN1 | in vitro | Hep3B | 30 | qRTPCR | SMN1:21171U20 |
| SMN1-16 | 0.73721881 | 0.038067583 | SMN1 | in vitro | RPTEC | 100 | qRTPCR | SMN1:21172U20 |
| SMN1-16 | 1.441616196 | 0.059823944 | SMN1 | in vitro | RPTEC | 50 | qRTPCR | SMN1:21172U20 |
| SMN1-16 | 0.510056605 | 0.286522659 | SMN1 | in vitro | Hep3B | 50 | qRTPCR | SMN1:21172U20 |
| SMN1-16 | 1.381914214 | 0.247880229 | SMN1 | in vitro | Hep3B | 100 | qRTPCR | SMN1:21172U20 |
| SMN1-16 | 1.310073573 | 0.026347093 | SMN1 | in vitro | Hep3B | 10 | qRTPCR | SMN1:21172U20 |
| SMN1-16 | 1.418132646 | 0.082371708 | SMN1 | in vitro | Hep3B | 30 | qRTPCR | SMN1:21172U20 |
| SMN1-17 | 1.219065651 | 0.281987674 | SMN1 | in vitro | RPTEC | 100 | qRTPCR | SMN1:21173U20 |
| SMN1-17 | 1.274819195 | 0.179527293 | SMN1 | in vitro | RPTEC | 50 | qRTPCR | SMN1:21173U20 |
| SMN1-17 | 0.416739222 | 0.066066242 | SMN1 | in vitro | Hep3B | 50 | qRTPCR | SMN1:21173U20 |
| SMN1-17 | 3.331843017 | 0.970174873 | SMN1 | in vitro | Hep3B | 100 | qRTPCR | SMN1:21173U20 |
| SMN1-17 | 1.260856522 | 0.038565799 | SMN1 | in vitro | Hep3B | 10 | qRTPCR | SMN1:21173U20 |
| SMN1-17 | 1.609045311 | 0.10487434 | SMN1 | in vitro | Hep3B | 30 | qRTPCR | SMN1:21173U20 |

TABLE 2-continued

Oligonucleotide sequences made for testing

| Oligo Name | RQ | RQ SE | Gene Name | Expt Type | Cell Line/Tissue | [Oligo] | Assay Type | Coordinates_g |
|---|---|---|---|---|---|---|---|---|
| SMN1-18 | 0.868441941 | 0.088184698 | SMN1 | in vitro | RPTEC | 100 | qRTPCR | SMN1:21174U20 |
| SMN1-18 | 1.221663574 | 0.064445539 | SMN1 | in vitro | RPTEC | 50 | qRTPCR | SMN1:21174U20 |
| SMN1-18 | 10.28455167 | 3.929310832 | SMN1 | in vitro | Hep3B | 50 | qRTPCR | SMN1:21174U20 |
| SMN1-18 | 1.800920764 | 0.42559045 | SMN1 | in vitro | Hep3B | 100 | qRTPCR | SMN1:21174U20 |
| SMN1-18 | 1.261752602 | 0.069817143 | SMN1 | in vitro | Hep3B | 10 | qRTPCR | SMN1:21174U20 |
| SMN1-18 | 1.592700796 | 0.199280916 | SMN1 | in vitro | Hep3B | 30 | qRTPCR | SMN1:21174U20 |
| SMN1-19 | 0.705512452 | 0.06496675 | SMN1 | in vitro | RPTEC | 100 | qRTPCR | SMN1:21175U20 |
| SMN1-19 | 1.43433309 | 0.075936965 | SMN1 | in vitro | RPTEC | 50 | qRTPCR | SMN1:21175U20 |
| SMN1-19 | 0.538932156 | 0.309273594 | SMN1 | in vitro | Hep3B | 50 | qRTPCR | SMN1:21175U20 |
| SMN1-19 | 1.17374637 | 0.179415746 | SMN1 | in vitro | Hep3B | 100 | qRTPCR | SMN1:21175U20 |
| SMN1-19 | 1.186141471 | 0.036729063 | SMN1 | in vitro | Hep3B | 10 | qRTPCR | SMN1:21175U20 |
| SMN1-19 | 1.834775368 | 0.155761723 | SMN1 | in vitro | Hep3B | 30 | qRTPCR | SMN1:21175U20 |
| SMN1-20 | 0.826303453 | 0.062998254 | SMN1 | in vitro | RPTEC | 100 | qRTPCR | SMN1:21176U20 |
| SMN1-20 | 1.505786689 | 0.170697984 | SMN1 | in vitro | RPTEC | 50 | qRTPCR | SMN1:21176U20 |
| SMN1-20 | 0.06244992 | 0.049069571 | SMN1 | in vitro | Hep3B | 50 | qRTPCR | SMN1:21176U20 |
| SMN1-20 | 1.541480855 | 0.461158669 | SMN1 | in vitro | Hep3B | 100 | qRTPCR | SMN1:21176U20 |
| SMN1-20 | 1.089985692 | 0.043750568 | SMN1 | in vitro | Hep3B | 10 | qRTPCR | SMN1:21176U20 |
| SMN1-20 | 1.41531375 | 0.146502726 | SMN1 | in vitro | Hep3B | 30 | qRTPCR | SMN1:21176U20 |
| SMN1-21 | 0.865566453 | 0.209455026 | SMN1 | in vitro | RPTEC | 100 | qRTPCR | SMN1:21177U20 |
| SMN1-21 | 1.466688787 | 0.116267764 | SMN1 | in vitro | RPTEC | 50 | qRTPCR | SMN1:21177U20 |
| SMN1-21 | 0.388233514 | 0.139680869 | SMN1 | in vitro | Hep3B | 50 | qRTPCR | SMN1:21177U20 |
| SMN1-21 | 1.366269447 | 0.239420557 | SMN1 | in vitro | Hep3B | 100 | qRTPCR | SMN1:21177U20 |
| SMN1-21 | 1.354554841 | 0.013175463 | SMN1 | in vitro | Hep3B | 10 | qRTPCR | SMN1:21177U20 |
| SMN1-21 | 2.026968382 | 0.27827902 | SMN1 | in vitro | Hep3B | 30 | qRTPCR | SMN1:21177U20 |
| SMN1-22 | 0.639934851 | 0.011679891 | SMN1 | in vitro | RPTEC | 100 | qRTPCR | SMN1:21178U20 |
| SMN1-22 | 1.242593923 | 0.02840519 | SMN1 | in vitro | RPTEC | 50 | qRTPCR | SMN1:21178U20 |
| SMN1-22 | 0.229857922 | 0.128101282 | SMN1 | in vitro | Hep3B | 50 | qRTPCR | SMN1:21178U20 |
| SMN1-22 | 1.499722255 | 0.568788539 | SMN1 | in vitro | Hep3B | 100 | qRTPCR | SMN1:21178U20 |
| SMN1-22 | 1.234783764 | 0.017119432 | SMN1 | in vitro | Hep3B | 10 | qRTPCR | SMN1:21178U20 |
| SMN1-22 | 1.509695591 | 0.175764156 | SMN1 | in vitro | Hep3B | 30 | qRTPCR | SMN1:21178U20 |
| SMN1-23 | 0.748031845 | 0.083732479 | SMN1 | in vitro | RPTEC | 100 | qRTPCR | SMN1:21179U20 |
| SMN1-23 | 1.33910973 | 0.070877143 | SMN1 | in vitro | RPTEC | 50 | qRTPCR | SMN1:21179U20 |
| SMN1-23 | 0.384143384 | 0.14723735 | SMN1 | in vitro | Hep3B | 50 | qRTPCR | SMN1:21179U20 |
| SMN1-23 | 2.620195611 | 0.342101826 | SMN1 | in vitro | Hep3B | 100 | qRTPCR | SMN1:21179U20 |
| SMN1-23 | 1.473663866 | 0.053762605 | SMN1 | in vitro | Hep3B | 10 | qRTPCR | SMN1:21179U20 |
| SMN1-23 | 1.920800418 | 0.127336842 | SMN1 | in vitro | Hep3B | 30 | qRTPCR | SMN1:21179U20 |
| SMN1-24 | 0.907436601 | 0.24201681 | SMN1 | in vitro | RPTEC | 100 | qRTPCR | SMN1:21180U20 |
| SMN1-24 | 1.28379369 | 0.158661709 | SMN1 | in vitro | RPTEC | 50 | qRTPCR | SMN1:21180U20 |
| SMN1-24 | 0.963100208 | 0.117802422 | SMN1 | in vitro | Hep3B | 50 | qRTPCR | SMN1:21180U20 |
| SMN1-24 | 0.994753299 | 0.268415648 | SMN1 | in vitro | Hep3B | 100 | qRTPCR | SMN1:21180U20 |
| SMN1-24 | 0.965440348 | 0.032646295 | SMN1 | in vitro | Hep3B | 10 | qRTPCR | SMN1:21180U20 |
| SMN1-24 | 1.140566171 | 0.10163121 | SMN1 | in vitro | Hep3B | 30 | qRTPCR | SMN1:21180U20 |
| SMN1-25 | 0.908854808 | 0.076026035 | SMN1 | in vitro | RPTEC | 100 | qRTPCR | SMN1:21181U20 |
| SMN1-25 | 1.226185041 | 0.044422705 | SMN1 | in vitro | RPTEC | 50 | qRTPCR | SMN1:21181U20 |
| SMN1-25 | 1.055082301 | 0.326768036 | SMN1 | in vitro | Hep3B | 50 | qRTPCR | SMN1:21181U20 |
| SMN1-25 | 0.969185038 | 0.226484866 | SMN1 | in vitro | Hep3B | 100 | qRTPCR | SMN1:21181U20 |
| SMN1-25 | 1.00974636 | 0.122120737 | SMN1 | in vitro | Hep3B | 10 | qRTPCR | SMN1:21181U20 |
| SMN1-25 | 1.081303639 | 0.101827303 | SMN1 | in vitro | Hep3B | 30 | qRTPCR | SMN1:21181U20 |
| SMN1-26 | 0.876444072 | 0.070457909 | SMN1 | in vitro | RPTEC | 100 | qRTPCR | SMN1:21182U20 |
| SMN1-26 | 1.632434888 | 0.061512357 | SMN1 | in vitro | RPTEC | 50 | qRTPCR | SMN1:21182U20 |
| SMN1-26 | 0.071593319 | 0.071592884 | SMN1 | in vitro | Hep3B | 50 | qRTPCR | SMN1:21182U20 |
| SMN1-26 | 1.999202516 | 0.420387669 | SMN1 | in vitro | Hep3B | 100 | qRTPCR | SMN1:21182U20 |
| SMN1-26 | 0.974107584 | 0.066863661 | SMN1 | in vitro | Hep3B | 10 | qRTPCR | SMN1:21182U20 |
| SMN1-26 | 1.030227891 | 0.096105098 | SMN1 | in vitro | Hep3B | 30 | qRTPCR | SMN1:21182U20 |
| SMN1-27 | 0.834365703 | 0.108102871 | SMN1 | in vitro | RPTEC | 100 | qRTPCR | SMN1:21157U15 |
| SMN1-27 | 1.589954219 | 0.093101653 | SMN1 | in vitro | RPTEC | 50 | qRTPCR | SMN1:21157U15 |
| SMN1-27 | 0.747186714 | 0.007807701 | SMN1 | in vitro | Hep3B | 30 | qRTPCR | SMN1:21157U15 |
| SMN1-27 | 1.049068744 | 0.092645193 | SMN1 | in vitro | Hep3B | 10 | qRTPCR | SMN1:21157U15 |
| SMN1-28 | 1.058343694 | 0.208931576 | SMN1 | in vitro | RPTEC | 100 | qRTPCR | SMN1:21158U15 |
| SMN1-28 | 1.402348414 | 0.101950771 | SMN1 | in vitro | RPTEC | 50 | qRTPCR | SMN1:21158U15 |
| SMN1-28 | 1.150224316 | 0.080077707 | SMN1 | in vitro | Hep3B | 30 | qRTPCR | SMN1:21158U15 |
| SMN1-28 | 1.219828396 | 0.031782762 | SMN1 | in vitro | Hep3B | 10 | qRTPCR | SMN1:21158U15 |
| SMN1-29 | 0.712268587 | 0.077572838 | SMN1 | in vitro | RPTEC | 100 | qRTPCR | SMN1:21159U15 |
| SMN1-29 | 1.145305552 | 0.044575389 | SMN1 | in vitro | RPTEC | 50 | qRTPCR | SMN1:21159U15 |
| SMN1-29 | 0.937393865 | 0.015700783 | SMN1 | in vitro | Hep3B | 30 | qRTPCR | SMN1:21159U15 |
| SMN1-29 | 1.208521962 | 0.084021899 | SMN1 | in vitro | Hep3B | 10 | qRTPCR | SMN1:21159U15 |
| SMN1-30 | 0.869504109 | 0.147682779 | SMN1 | in vitro | RPTEC | 100 | qRTPCR | SMN1:21160U15 |
| SMN1-30 | 1.166995709 | 0.128900531 | SMN1 | in vitro | RPTEC | 50 | qRTPCR | SMN1:21160U15 |
| SMN1-30 | 1.069533423 | 0.042258392 | SMN1 | in vitro | Hep3B | 30 | qRTPCR | SMN1:21160U15 |
| SMN1-30 | 1.004618999 | 0.068245537 | SMN1 | in vitro | Hep3B | 10 | qRTPCR | SMN1:21160U15 |
| SMN1-31 | 1.223685297 | 0.155258366 | SMN1 | in vitro | Hep3B | 30 | qRTPCR | SMN1:21161U15 |
| SMN1-31 | 0.936569575 | 0.083367899 | SMN1 | in vitro | Hep3B | 10 | qRTPCR | SMN1:21161U15 |
| SMN1-32 | 1.032978469 | 0.02312057 | SMN1 | in vitro | Hep3B | 30 | qRTPCR | SMN1:21162U15 |
| SMN1-32 | 1.053045821 | 0.030158389 | SMN1 | in vitro | Hep3B | 10 | qRTPCR | SMN1:21162U15 |
| SMN1-33 | 1.046361407 | 0.038971809 | SMN1 | in vitro | Hep3B | 30 | qRTPCR | SMN1:21163U15 |

TABLE 2-continued

Oligonucleotide sequences made for testing

| Oligo Name | RQ | RQ SE | Gene Name | Expt Type | Cell Line/Tissue | [Oligo] | Assay Type | Coordinates_g |
|---|---|---|---|---|---|---|---|---|
| SMN1-33 | 1.233302232 | 0.063255341 | SMN1 | in vitro | Hep3B | 10 | qRTPCR | SMN1:21163U15 |
| SMN1-34 | 1.079876751 | 0.09859402 | SMN1 | in vitro | Hep3B | 30 | qRTPCR | SMN1:21164U15 |
| SMN1-34 | 1.271026183 | 0.067019476 | SMN1 | in vitro | Hep3B | 10 | qRTPCR | SMN1:21164U15 |
| SMN1-35 | 0.861464008 | 0.024095912 | SMN1 | in vitro | Hep3B | 30 | qRTPCR | SMN1:21165U15 |
| SMN1-35 | 0.836966392 | 0.054159619 | SMN1 | in vitro | Hep3B | 10 | qRTPCR | SMN1:21165U15 |
| SMN1-36 | 1.26636324 | 0.046963681 | SMN1 | in vitro | Hep3B | 30 | qRTPCR | SMN1:21166U15 |
| SMN1-36 | 1.326257117 | 0.039674649 | SMN1 | in vitro | Hep3B | 10 | qRTPCR | SMN1:21166U15 |
| SMN1-37 | 1.232690086 | 0.043476252 | SMN1 | in vitro | Hep3B | 30 | qRTPCR | SMN1:21167U15 |
| SMN1-37 | 1.144632987 | 0.058433353 | SMN1 | in vitro | Hep3B | 10 | qRTPCR | SMN1:21167U15 |
| SMN1-38 | 0.843241863 | 0.033808043 | SMN1 | in vitro | Hep3B | 30 | qRTPCR | SMN1:21168U15 |
| SMN1-38 | 0.93818033 | 0.011376217 | SMN1 | in vitro | Hep3B | 10 | qRTPCR | SMN1:21168U15 |
| SMN1-39 | 0.663746249 | 0.045527014 | SMN1 | in vitro | Hep3B | 30 | qRTPCR | SMN1:21169U15 |
| SMN1-39 | 0.891764551 | 0.019395327 | SMN1 | in vitro | Hep3B | 10 | qRTPCR | SMN1:21169U15 |
| SMN1-40 | 0.888138653 | 0.081401804 | SMN1 | in vitro | Hep3B | 30 | qRTPCR | SMN1:21170U15 |
| SMN1-40 | 0.871602899 | 0.065372936 | SMN1 | in vitro | Hep3B | 10 | qRTPCR | SMN1:21170U15 |
| SMN1-41 | 0.882466148 | 0.031016749 | SMN1 | in vitro | Hep3B | 30 | qRTPCR | SMN1:21171U15 |
| SMN1-41 | 1.093694765 | 0.025996502 | SMN1 | in vitro | Hep3B | 10 | qRTPCR | SMN1:21171U15 |
| SMN1-42 | 0.956860836 | 0.043558382 | SMN1 | in vitro | Hep3B | 30 | qRTPCR | SMN1:21172U15 |
| SMN1-42 | 1.151755999 | 0.067662107 | SMN1 | in vitro | Hep3B | 10 | qRTPCR | SMN1:21172U15 |
| SMN1-43 | 1.341919782 | 0.08080776 | SMN1 | in vitro | Hep3B | 30 | qRTPCR | SMN1:21173U15 |
| SMN1-43 | 1.692919815 | 0.084669198 | SMN1 | in vitro | Hep3B | 10 | qRTPCR | SMN1:21173U15 |
| SMN1-44 | 0 | 0 | SMN1 | NA | NA | 0 | NA | SMN1:21174U15 |
| SMN1-45 | 1.807236897 | 0.11410948 | SMN1 | in vitro | Hep3B | 30 | qRTPCR | SMN1:21175U15 |
| SMN1-45 | 1.377773703 | 0.108540058 | SMN1 | in vitro | Hep3B | 10 | qRTPCR | SMN1:21175U15 |
| SMN1-46 | 1.545649538 | 0.064006814 | SMN1 | in vitro | Hep3B | 30 | qRTPCR | SMN1:21176U15 |
| SMN1-46 | 1.354291504 | 0.038498944 | SMN1 | in vitro | Hep3B | 10 | qRTPCR | SMN1:21176U15 |
| SMN1-47 | 2.711598361 | 0.260043446 | SMN1 | in vitro | Hep3B | 30 | qRTPCR | SMN1:21177U15 |
| SMN1-47 | 1.986674786 | 0.119436675 | SMN1 | in vitro | Hep3B | 10 | qRTPCR | SMN1:21177U15 |
| SMN1-48 | 1.482342195 | 0.063036343 | SMN1 | in vitro | Hep3B | 30 | qRTPCR | SMN1:21178U15 |
| SMN1-48 | 2.597350628 | 0.145439801 | SMN1 | in vitro | Hep3B | 10 | qRTPCR | SMN1:21178U15 |
| SMN1-49 | 1.534493905 | 0.110688365 | SMN1 | in vitro | Hep3B | 30 | qRTPCR | SMN1:21179U15 |
| SMN1-49 | 2.223340784 | 0.148702992 | SMN1 | in vitro | Hep3B | 10 | qRTPCR | SMN1:21179U15 |
| SMN1-50 | 0.897421396 | 0.034254931 | SMN1 | in vitro | Hep3B | 30 | qRTPCR | SMN1:21180U15 |
| SMN1-50 | 1.132362781 | 0.078523003 | SMN1 | in vitro | Hep3B | 10 | qRTPCR | SMN1:21180U15 |
| SMN1-51 | 1.157921368 | 0.044256319 | SMN1 | in vitro | Hep3B | 30 | qRTPCR | SMN1:21181U15 |
| SMN1-51 | 1.177604665 | 0.038060353 | SMN1 | in vitro | Hep3B | 10 | qRTPCR | SMN1:21181U15 |
| SMN1-52 | 0.973548353 | 0.051461583 | SMN1 | in vitro | Hep3B | 30 | qRTPCR | SMN1:21182U15 |
| SMN1-52 | 1.068355642 | 0.060851146 | SMN1 | in vitro | Hep3B | 10 | qRTPCR | SMN1:21182U15 |

TABLE 3

Oligonucleotide Modifications

| Symbol | Feature Description |
|---|---|
| bio | 5' biotin |
| dAs | DNA w/3' thiophosphate |
| dCs | DNA w/3' thiophosphate |
| dGs | DNA w/3' thiophosphate |
| dTs | DNA w/3' thiophosphate |
| dG | DNA |
| enaAs | ENA w/3' thiophosphate |
| enaCs | ENA w/3' thiophosphate |
| enaGs | ENA w/3' thiophosphate |
| enaTs | ENA w/3' thiophosphate |
| fluAs | 2'-fluoro w/3' thiophosphate |
| fluCs | 2'-fluoro w/3' thiophosphate |
| fluGs | 2'-fluoro w/3' thiophosphate |
| fluUs | 2'-fluoro w/3' thiophosphate |
| lnaAs | LNA w/3' thiophosphate |
| lnaCs | LNA w/3' thiophosphate |
| lnaGs | LNA w/3' thiophosphate |
| lnaTs | LNA w/3' thiophosphate |
| omeAs | 2'-OMe w/3' thiophosphate |
| omeCs | 2'-OMe w/3' thiophosphate |
| omeGs | 2'-OMe w/3' thiophosphate |
| omeTs | 2'-OMe w/3' thiophosphate |
| lnaAs-Sup | LNA w/3' thiophosphate at 3' terminus |
| lnaCs-Sup | LNA w/3' thiophosphate at 3' terminus |
| lnaGs-Sup | LNA w/3' thiophosphate at 3' terminus |
| lnaTs-Sup | LNA w/3' thiophosphate at 3' terminus |
| lnaA-Sup | LNA w/3' OH at 3' terminus |
| lnaC-Sup | LNA w/3' OH at 3' terminus |
| lnaG-Sup | LNA w/3' OH at 3' terminus |
| lnaT-Sup | LNA w/3' OH at 3' terminus |
| omeA-Sup | 2'-OMe w/3' OH at 3' terminus |
| omeC-Sup | 2'-OMe w/3' OH at 3' terminus |
| omeG-Sup | 2'-OMe w/3' OH at 3' terminus |
| omeU-Sup | 2'-OMe w/3' OH at 3' terminus |
| dAs-Sup | DNA w/3' thiophosphate at 3' terminus |
| dCs-Sup | DNA w/3' thiophosphate at 3' terminus |
| dGs-Sup | DNA w/3' thiophosphate at 3' terminus |
| dTs-Sup | DNA w/3' thiophosphate at 3' terminus |
| dA-Sup | DNA w/3' OH at 3' terminus |
| dC-Sup | DNA w/3' OH at 3' terminus |
| dG-Sup | DNA w/3' OH at 3' terminus |
| dT-Sup | DNA w/3' OH at 3' terminus |

BRIEF DESCRIPTION OF SEQUENCE LISTING

| SeqID | Chrom | Gene | Chrom Start | Chrom End | Strand | Name |
|---|---|---|---|---|---|---|
| 1 | chr5 | SMN1 | 70208768 | 70260838 | + | human SMN1 |
| 2 | chr5 | SMN2 | 69333350 | 69385422 | + | human SMN2 |
| 3 | chr9 | SMNP | 20319406 | 20344375 | + | human SMNP |
| 4 | chr5 | SMN1 | 70208768 | 70260838 | − | human SMN1_revComp |
| 5 | chr5 | SMN2 | 69333350 | 69385422 | − | human SMN2_revComp |
| 6 | chr9 | SMNP | 20319406 | 20344375 | − | human SMNP_revComp |
| 7 | chr13 | Smn1 | 100881160 | 100919653 | + | mouse Smn1 |
| 8 | chr13 | Smn1 | 100881160 | 100919653 | − | mouse Smn1_revComp |
| 9 | chr5 | SMN1 | 70240095 | 70240127 | + | S48-193240 |
| 9 | chr5 | SMN2 | 69364672 | 69364704 | + | S48-193240 |
| 10 | chr5 | SMN1 | 70214393 | 70214822 | + | S48-441814 |
| 10 | chr5 | SMN2 | 69338976 | 69339405 | + | S48-441814 |
| 11 | chr5 | SMN1 | 70214064 | 70214108 | + | S48-441815 |
| 11 | chr5 | SMN2 | 69338647 | 69338691 | + | S48-441815 |
| 12 | chr5 | SMN1 | 70214276 | 70214317 | + | S48-473289 |
| 12 | chr5 | SMN2 | 69338859 | 69338900 | + | S48-473289 |
| 13 | chr5 | SMN1 | 70214445 | 70214472 | + | S48-473290 |
| 13 | chr5 | SMN2 | 69339028 | 69339055 | + | S48-473290 |
| 14 | chr5 | SMN1 | 70238095 | 70242127 | + | S48-193240 + 2K |
| 15 | chr5 | SMN2 | 69362672 | 69366704 | + | S48-193240 + 2K |
| 16 | chr5 | SMN1 | 70212393 | 70216822 | + | S48-441814 + 2K |
| 17 | chr5 | SMN2 | 69336976 | 69341405 | + | S48-441814 + 2K |
| 18 | chr5 | SMN1 | 70212064 | 70216108 | + | S48-441815 + 2K |
| 19 | chr5 | SMN2 | 69336647 | 69340691 | + | S48-441815 + 2K |
| 20 | chr5 | SMN1 | 70212276 | 70216317 | + | S48-473289 + 2K |
| 21 | chr5 | SMN2 | 69336859 | 69340900 | + | S48-473289 + 2K |
| 22 | chr5 | SMN1 | 70212445 | 70216472 | + | S48-473290 + 2K |
| 23 | chr5 | SMN2 | 69337028 | 69341055 | + | S48-473290 + 2K |
| 24 | chr5 | SMN1 | 70240510 | 70240551 | − | S48-193241 |
| 24 | chr5 | SMN2 | 69365087 | 69365128 | − | S48-193241 |
| 25 | chr5 | SMN1 | 70241924 | 70241968 | − | S48-193242 |
| 25 | chr5 | SMN2 | 69366499 | 69366543 | − | S48-193242 |
| 26 | chr5 | SMN1 | 70238510 | 70242551 | − | S48-193241 + 2K |
| 27 | chr5 | SMN2 | 69363087 | 69367128 | − | S48-193241 + 2K |
| 28 | chr5 | SMN1 | 70239924 | 70243968 | − | S48-193242 + 2K |
| 29 | chr5 | SMN2 | 69364499 | 69368543 | − | S48-193242 + 2K |
| 13100 | chr5 | SMN1 | 70247831 | 70247845 | + | Splice control sequence |
| 13100 | chr5 | SMN2 | 69372411 | 69372425 | + | Splice control sequence |
| 13101 | chr5 | SMN2 | 69372402 | 69372845 | + | Intron 7 |

Single Strand Oligonucleotides (Antisense Strand of Target Gene)
SeqID range: 30 to 8329, 13088-13094
SeqIDs w/o G Runs:
30-142, 156-560, 575-780, 794-912, 926-1013, 1027-1078, 1092-1286, 1300-1335, 1349-1385, 1399-1453, 1460-1527, 1548-1555, 1571-1653, 1675-1691, 1706-1802, 1816-1883, 1897-2009, 2023-2141, 2165-2289, 2303-2320, 2334-2447, 2461-2494, 2508-2526, 2540-2545, 2571-2635, 2651-2670, 2689-2763, 2772-2814, 2828-2854, 2868-3030, 3044-3256, 3270-3360, 3374-3400, 3414-3722, 3737, 3759-3783, 3797-3970, 3986-4059, 4073-4153, 4175-4240, 4255-4415, 4438-4441, 4456-4472, 4484-4505, 4513-4516, 4531-4546, 4560-4650, 4664-4751, 4766-4918, 4932-5035, 5049-5064, 5091-5189, 5203-5448, 5459-5503, 5508-5520, 5535-5654, 5668-5863, 5877-6016, 6025-6029, 6054-6063, 6078-6215, 6229-6701, 6715-6729, 6744-6869, 6883-6945, 6959-6968, 6982-7085, 7099-7173, 7195-7247, 7255-7268, 7273-7309, 7320-7335, 7349-7442, 7456-7465, 7479-7727, 7740-7951, 7977-8208, 8223-8255, 8257-8296, 8304-8312, 8319-8329, 13093-13094
SeqIDs w/o miR Seeds:
30-32, 34-39, 45-62, 64-72, 77-142, 145-151, 153, 157-184, 186-202, 205-246, 249, 251-260, 263, 266-320, 322, 326-328, 331, 333-341, 343-344, 346-394, 396-445, 447-541, 543-562, 564-596, 599-605, 607-646, 648-673, 677-701, 703-735, 737-772, 774-781, 785, 787-793, 795-809, 812, 814-815, 819-820, 822-827, 833-834, 836, 838-850, 852-876, 879, 883-886, 889-890, 892, 894, 897, 899, 901-906, 909, 911, 919, 921-935, 940, 942-1012, 1016-1063, 1065-1067, 1069-1095, 1097-1147, 1149-1166, 1168-1190, 1193-1214, 1217, 1227-1237, 1240, 1244, 1246-1251, 1258-1281, 1283-1312, 1314-1333, 1335, 1337-1356, 1358-1364, 1367, 1369-1381, 1384, 1388-1389, 1392-1404, 1406-1417, 1421-1441, 1443, 1445, 1447-1460, 1462-1492, 1494-1500, 1502, 1506-1512, 1514-1531, 1533, 1535-1539, 1543-1558, 1561-1562, 1564-1601, 1603-1614, 1616-1633, 1635-1646, 1648-1656, 1658, 1661-1675, 1678-1716, 1718-1740, 1742-1750, 1752-1785, 1788-1795, 1798, 1804-1871, 1873-1884, 1892-1973, 1976-1992, 1998-2032, 2034-2053, 2055-2077, 2079-2116, 2118-2135, 2138, 2142, 2149, 2151-2153, 2155-2162, 2165-2174, 2178, 2181-2254, 2256-2268, 2271-2293, 2296-2298, 2301-2312, 2314-2323, 2325-2427, 2429-2438, 2441, 2445, 2450-2476, 2478-2489, 2492-2494, 2497-2513, 2515, 2521-2526, 2529-2545, 2547-2571, 2573-2610, 2613-2620, 2622-2639, 2641, 2644, 2651-2743, 2745, 2747-2755, 2760-2775, 2777-2825, 2828-2841, 2844-2861, 2864-2888, 2894-2954, 2956-2988, 2991-3006, 3008-3043, 3046, 3048-3239, 3241-3253, 3256-3268, 3270-3273, 3276-3320, 3322-3355, 3357-3404, 3406-3428, 3430-3488, 3490-3491, 3493-3522, 3524-3552, 3554-3569, 3571-3650, 3653-3670, 3672-3688, 3690-3717, 3719-3724, 3727-3736, 3743, 3746, 3749, 3751-3821, 3823-3842, 3844, 3846, 3848, 3851, 3855, 3858, 3861-3863, 3866-3881, 3883, 3887-3907, 3909-3917, 3919-3924, 3926-3942, 3944-3952, 3956-3970, 3976-3988, 3991-3998, 4001-4008, 4010-4022, 4026, 4028-4039, 4041-4048, 4051-4059, 4063-4070, 4072-4073, 4075, 4078, 4080-4104, 4106-4124, 4126, 4129-4140, 4143-4153, 4156-

4162, 4166-4171, 4174-4196, 4201-4241, 4244-4252, 4254-4285, 4289-4318, 4320-4324, 4327, 4330-4331, 4333-4335, 4337-4351, 4353-4414, 4417, 4419-4425, 4427-4433, 4435, 4438-4446, 4449-4450, 4452-4462, 4470-4472, 4474-4510, 4512-4517, 4520-4546, 4548, 4551-4590, 4592-4619, 4623-4696, 4699, 4701, 4703-4752, 4755-4877, 4879-4949, 4951-5007, 5010, 5013-5046, 5049-5059, 5061-5063, 5066, 5069-5078, 5080-5119, 5121-5131, 5134-5168, 5171-5189, 5191-5228, 5230-5341, 5343-5405, 5407-5426, 5429-5437, 5439-5476, 5478-5491, 5494-5516, 5518-5556, 5558-5572, 5574-5647, 5649, 5652-5653, 5657-5729, 5731-5742, 5744-5769, 5771-5780, 5782-5866, 5868, 5870-5876, 5879-5881, 5884-5899, 5902-5951, 5954-5993, 6000-6006, 6009-6016, 6019-6033, 6035-6065, 6067-6073, 6080-6165, 6168-6249, 6252-6257, 6261-6282, 6284-6289, 6291-6301, 6305-6367, 6369-6378, 6380-6398, 6401-6412, 6415, 6417-6447, 6449-6456, 6458-6500, 6502-6563, 6565-6589, 6591-6612, 6616-6660, 6663-6702, 6704-6748, 6753, 6758-6763, 6765, 6768-6807, 6810, 6812-6872, 6874-6877, 6879-6913, 6915-6916, 6919, 6922, 6924-6926, 6928, 6930-6936, 6940-6959, 6962, 6964-6990, 6992, 6996, 6998-6999, 7004-7038, 7042-7085, 7087, 7089, 7092-7134, 7136-7140, 7142-7143, 7146-7150, 7152-7157, 7159-7171, 7175, 7177-7178, 7180-7196, 7198-7220, 7223, 7231-7237, 7239, 7242-7246, 7250-7273, 7275-7308, 7310-7312, 7314-7317, 7319-7330, 7332-7400, 7402-7437, 7439, 7441-7466, 7470-7491, 7493, 7495, 7497, 7499, 7502-7614, 7622-7628, 7631-7646, 7649-7651, 7655-7657, 7661-7672, 7676, 7679-7721, 7723-7800, 7802-7803, 7805-7906, 7908, 7910-7939, 7943-7953, 7956-7964, 7966-7981, 7983, 7985-7999, 8002, 8004-8034, 8036-8046, 8048-8080, 8084-8094, 8096-8112, 8114-8115, 8117-8139, 8141-8143, 8146-8148, 8150-8187, 8190-8216, 8218-8229, 8232-8238, 8240-8250, 8253-8255, 8257-8275, 8278-8296, 8299-8304, 8306-8329, 13093-13094

Single Strand Oligonucleotides (Sense Strand of Target Gene)
SeqID range: 1158-1159, 1171, 1482-1483, 1485-1486, 2465-2471, 2488-2490, 2542-2546, 2656-2657, 2833-2835, 3439-3440, 3916-3918, 4469-4472, 4821, 5429, 5537, 6061, 7327, 8330-13061, 13062-13087

SeqIDs w/o G Runs:
1158-1159, 1171, 1482-1483, 1485-1486, 2465-2471, 2488-2490, 2542-2545, 2656-2657, 2833-2835, 3439-3440, 3916-3918, 4469-4472, 4821, 5429, 5537, 6061, 7327, 8330-8495, 8520-8560, 8574-8837, 8857-8882, 8907-8964, 8978-9298, 9312-9382, 9394-9640, 9656-9753, 9767-9974, 9988-10261, 10275-10276, 10290-10301, 10315-10434, 10448-10613, 10623-10641, 10644-10676, 10678-10704, 10714-10802, 10822-11161, 11175-11192, 11207-11386, 11400-11730, 11744-11745, 11759-11852, 11857-11900, 11914-11984, 11999-12011, 12026-12153, 12163-12175, 12178-12195, 12198-12212, 12216-12536, 12547-12564, 12575-12664, 12674-12758, 12772-12797, 12800-12840, 12854-13061, 13062-13069

SeqIDs w/o miR Seeds:
1158-1159, 1171, 1482-1483, 1485-1486, 2465-2471, 2488-2489, 2542-2545, 2656-2657, 2833-2835, 3439-3440, 3916-3917, 4470-4472, 4821, 5429, 5537, 6061, 7327, 8330-8334, 8336-8345, 8347, 8351-8373, 8375-8390, 8392-8399, 8401-8413, 8415-8455, 8457-8493, 8495, 8497-8502, 8510-8517, 8520, 8525, 8527-8634, 8637-8653, 8655-8671, 8673-8718, 8721-8822, 8824-8825, 8827-8842, 8849-8879, 8881-8892, 8894-8902, 8905-8906, 8914-8927, 8929, 8931, 8935, 8937-8975, 8980-8992, 8994, 8996-8997, 8999-9001, 9003, 9005-9086, 9089-9124, 9126-9286, 9288-9307, 9310-9359, 9362-9420, 9425-9427, 9429-9432, 9434, 9436-9437, 9439-9461, 9464-9483, 9486, 9488-9498, 9500-9511, 9513, 9515-9650, 9653-9667, 9669, 9671-9723, 9725-9869, 9871-9872, 9874-9879, 9881-9889, 9891-9973, 9975-10077, 10080-10097, 10099, 10101-10127, 10129-10166, 10168-10170, 10172-10184, 10186-10230, 10232-10237, 10239-10260, 10262-10272, 10274-10342, 10344-10400, 10402-10423, 10426-10441, 10445-10556, 10560, 10562-10580, 10582-10606, 10609-10647, 10650, 10652-10704, 10706, 10710-10713, 10716-10731, 10733-10824, 10826-10842, 10844-10903, 10906-10907, 10909-11101, 11104, 11106-11134, 11137-11138, 11145-11161, 11164-11173, 11175-11181, 11184, 11186-11203, 11207-11212, 11214-11239, 11243-11259, 11261-11347, 11351-11397, 11399-11740, 11742-11747, 11749-11790, 11792-11817, 11821-11852, 11854-11904, 11908-11944, 11946-11959, 11961, 11964-11984, 11986-12007, 12009-12022, 12024-12092, 12095-12119, 12121-12133, 12135-12144, 12146-12157, 12159-12225, 12227-12231, 12233-12300, 12302-12329, 12332-12333, 12335-12382, 12385-12411, 12414-12416, 12418-12444, 12446-12455, 12457-12461, 12465, 12468-12474, 12476-12499, 12501-12536, 12538-12544, 12547-12553, 12559-12610, 12612-12626, 12628-12631, 12633-12637, 12640-12645, 12648-12657, 12659-12671, 12673-12679, 12683-12710, 12712, 12714-12747, 12750, 12752-12766, 12769, 12771-12806, 12808-12826, 12828-12829, 12831, 12833-12846, 12848-12849, 12854-12931, 12933-12946, 12948-13061, 13064, 13066-13068, 13071-13072, 13075, 13077-13081, 13083, 13085, 13087

Example 2: Selective Upregulation of Exon 7 Containing SMN2 Transcripts Using Oligonucleotides Targeting PRC2-Interacting Regions that Upregulate SMN2 and Splice-Switching Oligonucleotides Oligo Design:

Oligonucleotides targeting PRC2-interacting regions (lncRNA peaks) in the SMN1/2 gene loci were designed. These oligos were synthesized with various DNA base modifications, modification placements, inter-nucleoside bonds and inter-oligo linkers (oligos 1-52 and 59-101) as outlined in Table 4.

Splice switching oligos (SSO) were designed based on sequences of SMN2. Various modifications of such SSOs in length and chemistry were prepared (oligos 53-58).

Universal negative control oligos (oligo 232 and 293) were also designed using on bioinformatic analysis.

Figure 2:
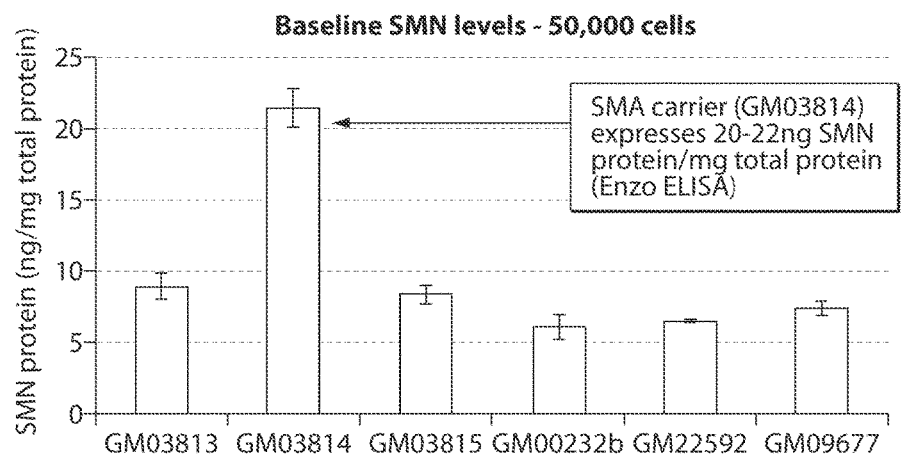
FIG. 2 provides a table outlining genotypes and patent information, including SMA classification, of cell lines tested in Example 2. Baseline SMN protein levels in the cell lines are also depicted.

Methods:

Cell Culture:

Six SMA fibroblast cell lines and one lymphoblast cell line were obtained from the Coriell Institute (FIG. 2). The cells were either transfected with the oligos using Lipofectamine2000 (Fibroblasts) or by electroporation or unassisted delivery (lymphoblast) to ascertain effects of the oligonucleotides on SMN1/2 mRNA and protein expression. All experiments were carried out as biological triplicates.

mRNA and Protein Expression:

mRNA Expression—

1. On day 1, SMA fibroblasts were seeded into each well of 96-well plates at a density of 5,000 cells per 100 uL.

2. On day 2, transfections were performed using Lipofectamie2000 per manufacturer's instructions with oligos at either 10 nM or 30 nM.

3. 48 hours post-transfection, Ambion Cells-to-CT kit was used to directly obtain qRT-PCR results from the cells per manufacturer's instructions.

4. Quantitative PCR evaluation was completed using Taqman FAST qPCR on StepOne Plus, and change in mRNA expression was quantified using the delta delta Ct method by normalizing SMN expression to a housekeeper gene (B2M).

Protein Expression (ELISA)—

ELISA to determine SMN protein was carried out per manufacturer's instructions (SMN ELISA kit #ADI-900-209, Enzo Life Sciences). Briefly, SMN fibroblasts were cultures at 40,000 cells/well of a 24-well tissue culture coated plate on day 1. Cells were transfected with the oligos using Lipofectamine2000 on day 2 and cell lysates prepared at 24 and 48 hours post-treatment. ELISA was carried out per manufacturer's instructions. Subsequently fold induction of SMN protein was determined by normalizing SMN protein levels induced by oligonucleotides to the SMN protein levels induced by Lipofectamine treatment alone.

Splice Switching Assay (DdeI Assay)—

Figure 5:
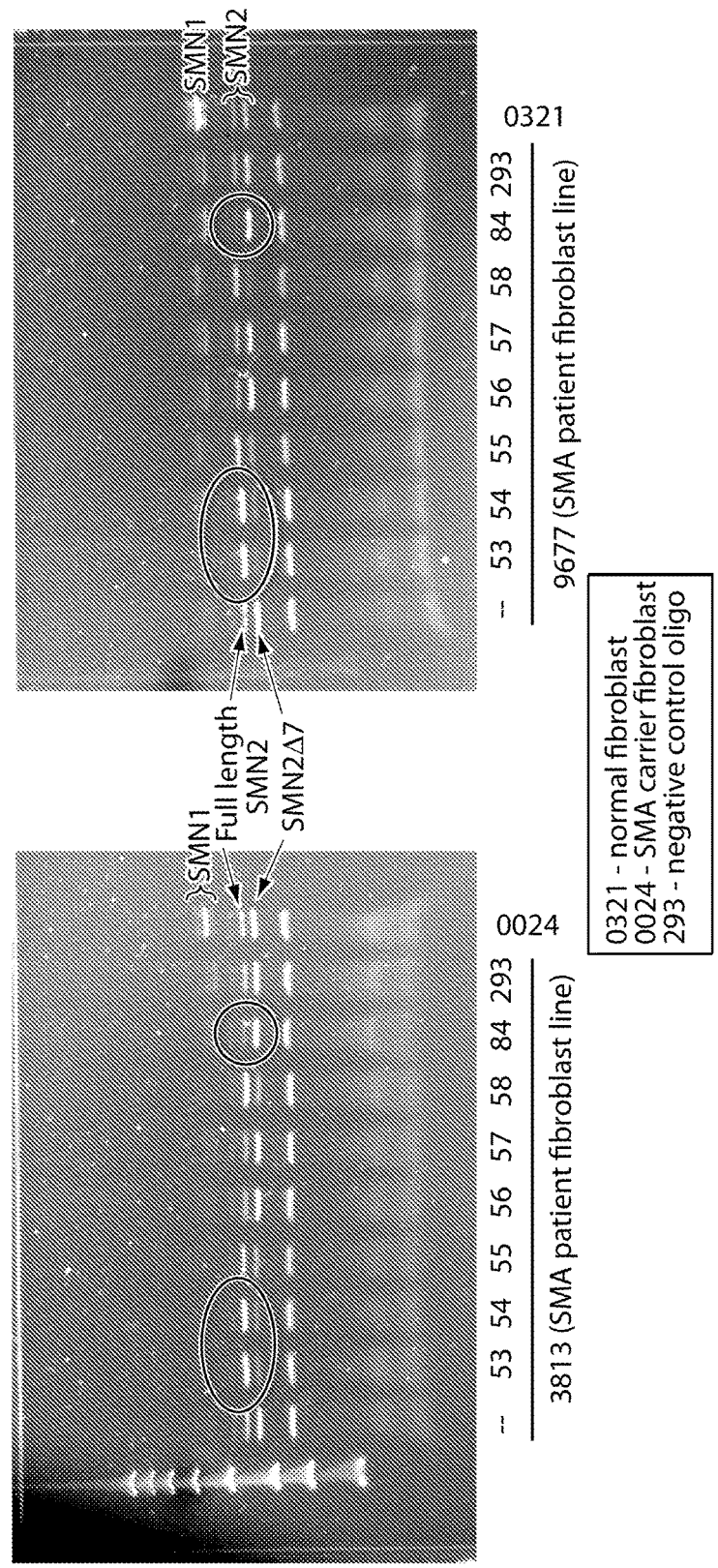
FIG. 5 shows that splice switching oligonucleotides (oligos 53-58) increase expression of full length SMN2. Results are based on a gel separation analysis of PCR products obtained following a DdeI restriction digest. Two cell lines were tested, 3813 and 9677. Oligo 84, which targets a PRC2-associated region of SMN2, did not exhibit an increase in full length SMN2 expression when delivered alone to cells.

SMN2-derived transcripts contain a unique DdeI restriction element introduced because of a nucleotide polymorphism not present in SMN1 and are differentiated from SMN1-derived transcripts because of the faster migration of the SMN2 products. Briefly, SMA fibroblasts were treated with oligonucleotides targeting PRC2-interacting regions with or without SSO at 30 nM each as described before. RT-PCR was carried out with an SMN exon 5 forward primer and an exon 8 reverse primer to generate cDNAs that were then digested with DdeI. The SMN1 transcript, if present, migrates at a slower rate than the DdeI-digested SMN2 transcript and is seen as the first band from the top of the gel. The second band from the top indicates full length SMN2 (accurately spliced form) and the third band indicates the incorrectly spliced SMN2delta7. (FIG. 5)

Results

In Spinal Muscular Atrophy patients, the SMN1 gene is often mutated in such a way that it is unable to correctly code the SMN protein—due to either a deletion encompassing at least a portion of exon 7 or to other mutations. SMA patients, however, generally retain at least one copy of the SMN2 gene (with many having 2 or more copies) that still expresses small amounts of SMN protein. The SMN2 gene has a C to T mutation (compared with SMN1) in exon 7 that alters splicing of its precursor mRNA such that exon 7 is spliced out at a high frequency. Consequently, only about 10% of the normal levels of full length SMN protein are produced from SMN2. (See FIG. 1)

Figure 3:
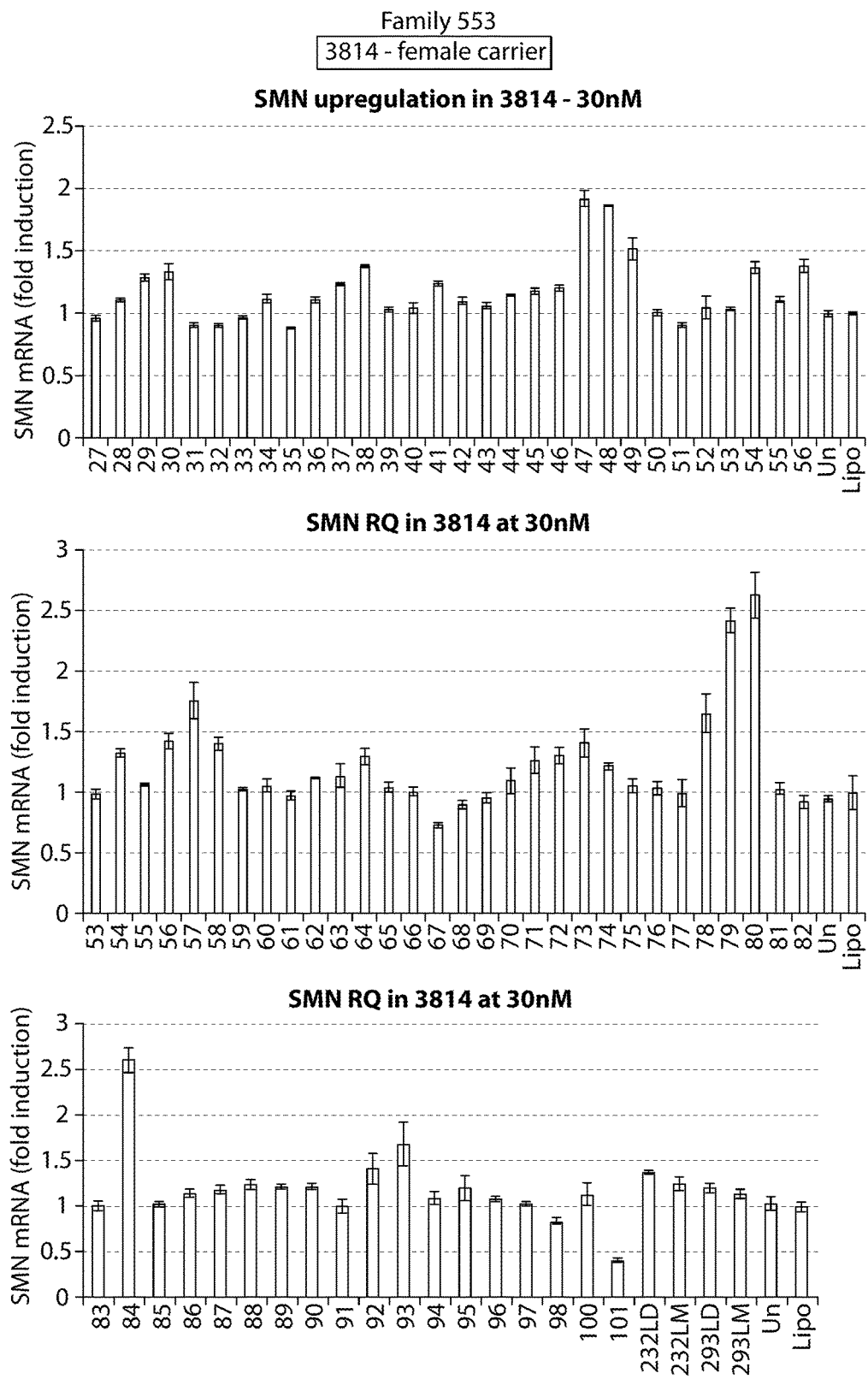
FIG. 3 depicts results of RT-PCR assays showing effects on SMN mRNA expression of oligonucleotides directed against a PRC2-associated region of SMN2 (oligos 1-52 and 59-101) and splice switching oligonucleotides (oligos 53-58) (PCR primers directed against exon 1 of SMN1/2) in cell line 3814.
Figure 4:
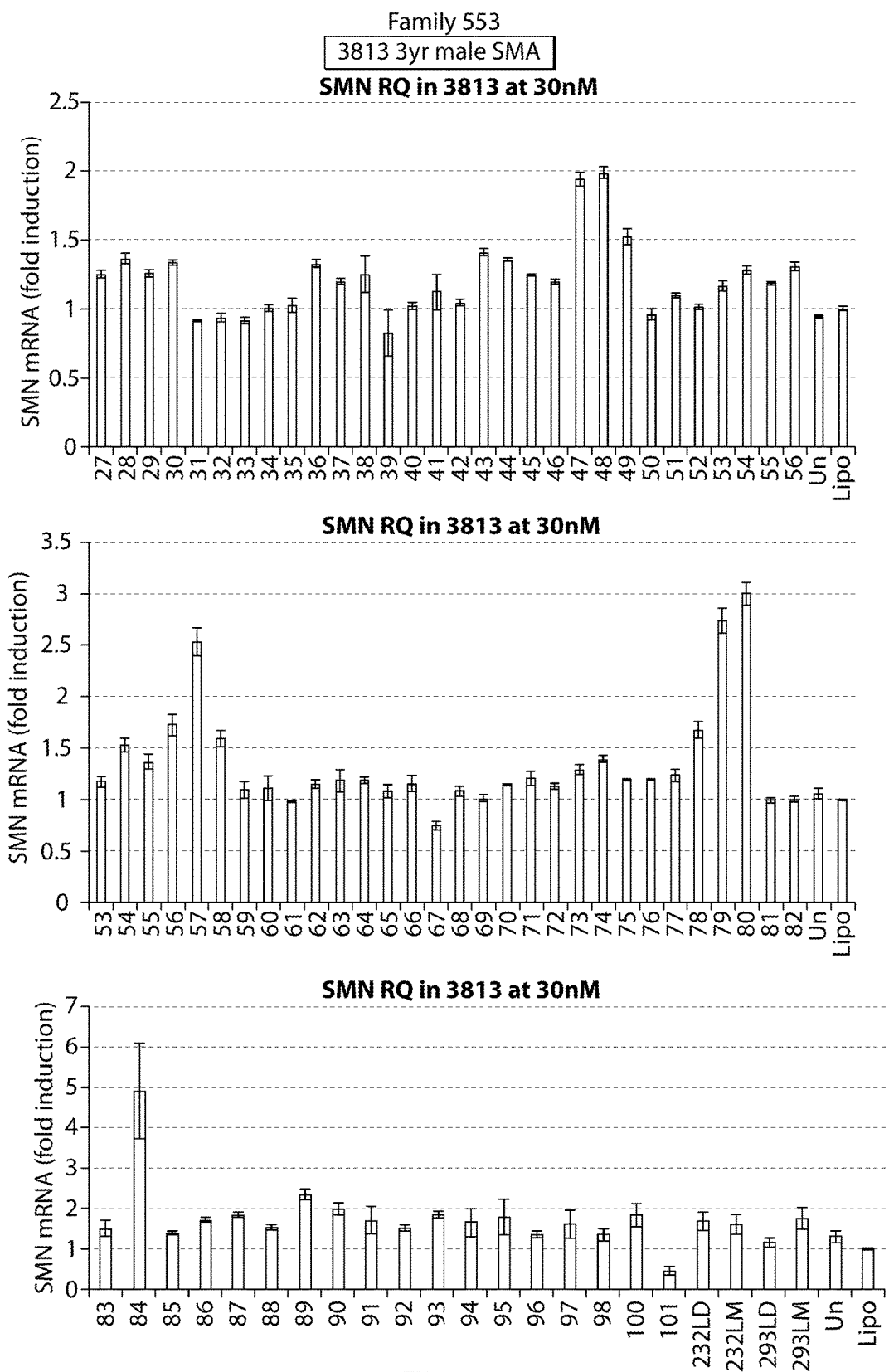
FIG. 4 depicts results of RT-PCR assays showing effects on SMN mRNA expression of oligonucleotides directed against a PRC2-associated region of SMN2 (oligos 1-52 and 59-101) and splice switching oligonucleotides (oligos 53-58) (PCR primers directed against exon 1 of SMN1/2) in cell line 3813.

Six SMA fibroblast cell lines and one lymphoblast cell line were obtained from the Coriell Institute (FIG. 2). Cells were transfected with oligonucleotides (oligos 1-52 and 59-101) directed against a PRC2-associated region of SMN2 and RT-PCR assays were conducted to evaluate effects on SMN mRNA expression. (See FIGS. 3 and 4 for results in cell lines 3814 and 3813). In separate experiments, cells were transfected with oligonucleotides (oligos 53-58) directed at a splice control sequence in intron 7 of SMN2 and RT-PCR assays were conducted to evaluate effects on SMN mRNA expression (See FIGS. 3 and 4 for results in cell lines 3814 and 3813). Splice switching oligonucleotides (oligos 53-58) were found to increase expression of full length SMN2 based on a gel separation analysis of PCR products obtained following a DdeI restriction digest; whereas certain oligonucleotides directed against a PRC2-associated region of SMN2 did not. (FIG. 5)

Figures 1, 6:
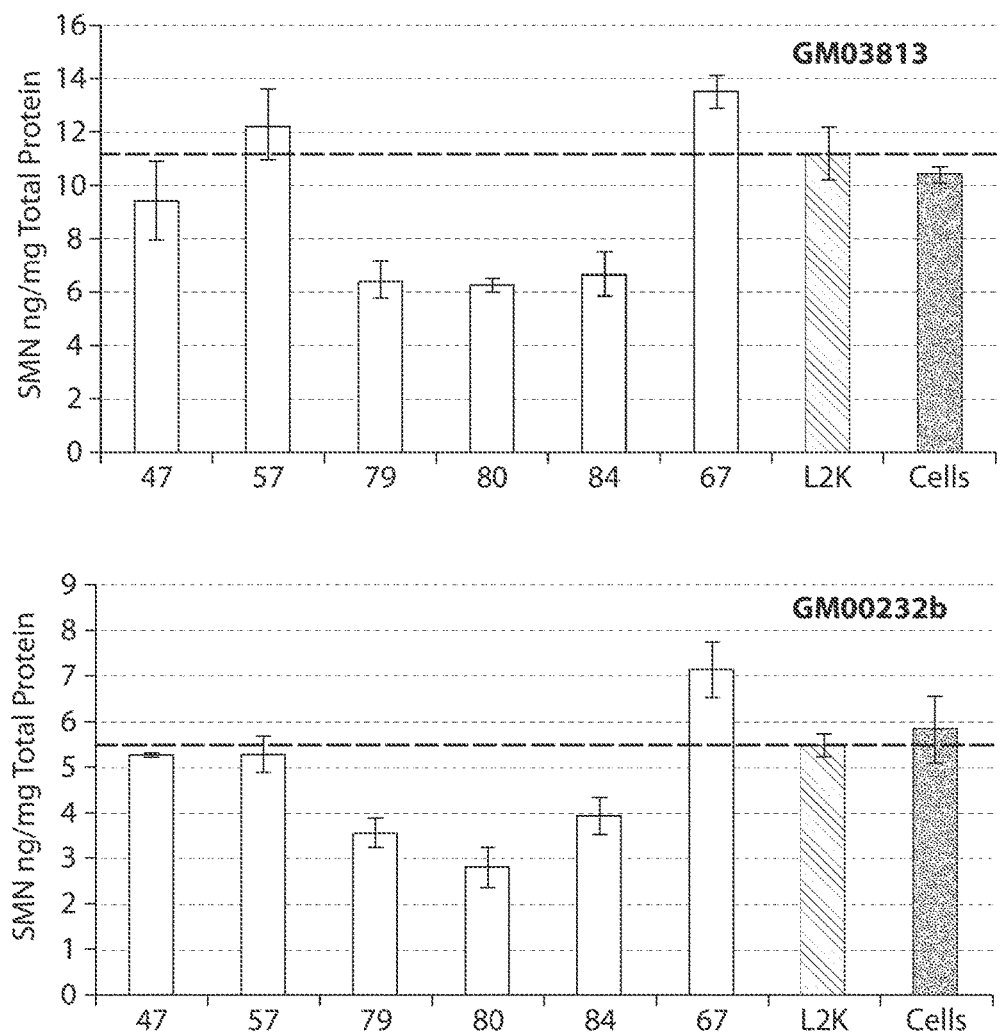
FIG. 6 provides results of an SMN ELISA (Enzo) showing that certain oligonucleotides directed against a PRC2-associated region of SMN2 alone do not significantly increase SMN2 protein 24 h post-transfection in certain SMA patient fibroblasts (compared to Lipofectamine treated cells—dashed line).
Figures 2, 6:
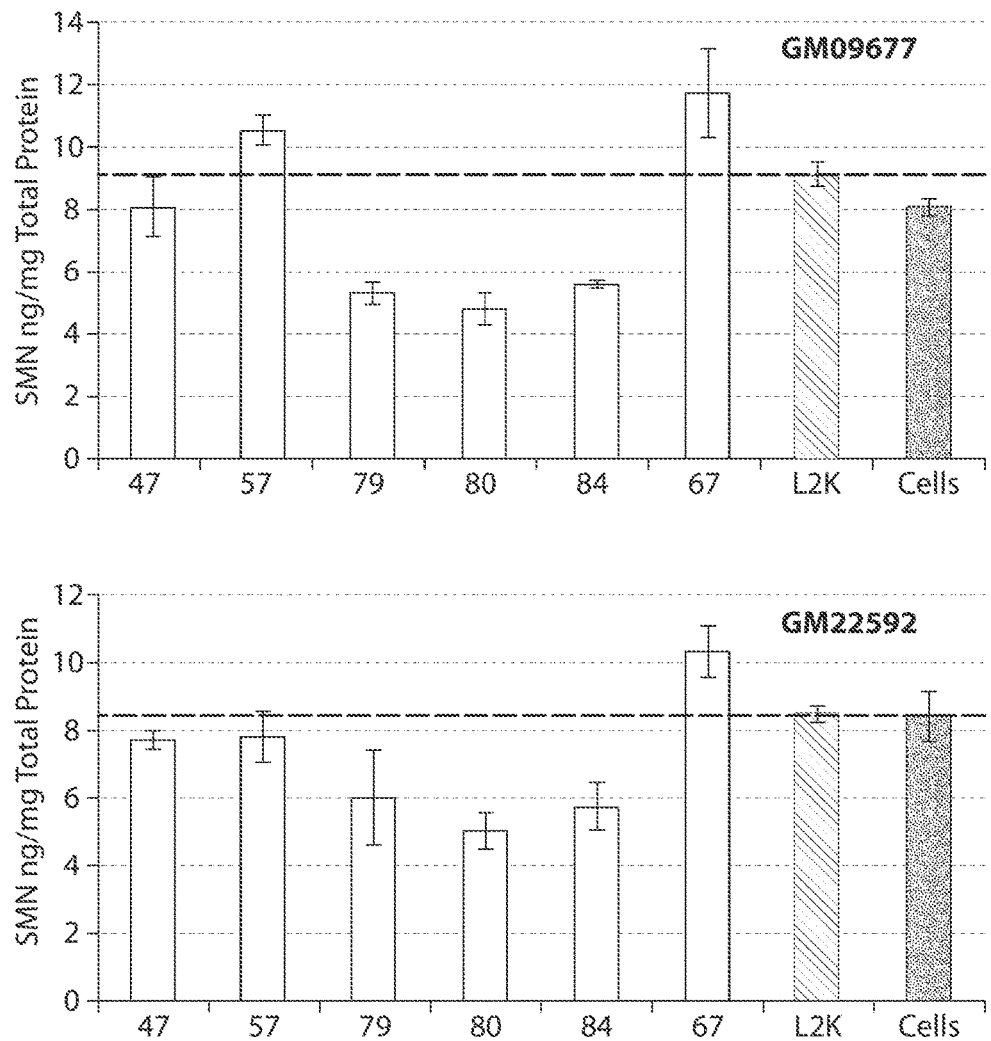
Figure 7:
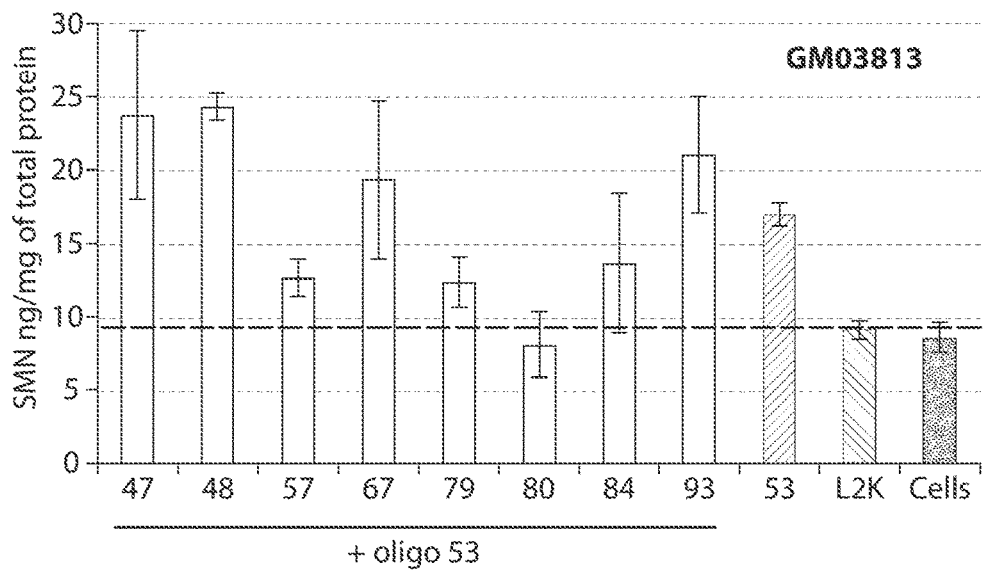
FIG. 7 provides results of an SMN ELISA showing that oligonucleotides directed against a PRC2-associated region of SMN2 in combination with a splice switching oligonucleotide (oligo 53) significantly increase SMN2 protein 24 h post-transfection in SMA patient fibroblasts (compared to Lipofectamine treated cells—dashed line).
Figure 1:
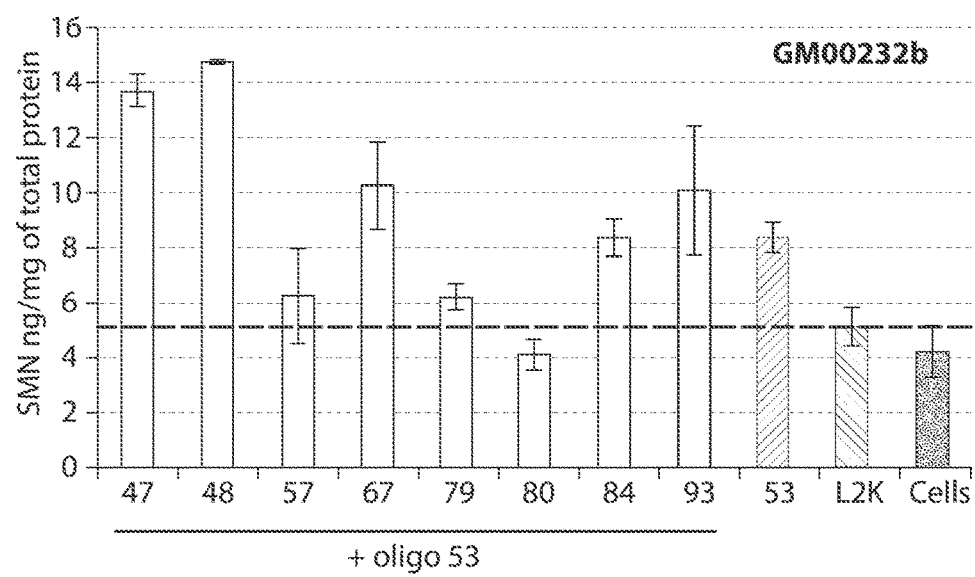
Figures 2, 7:
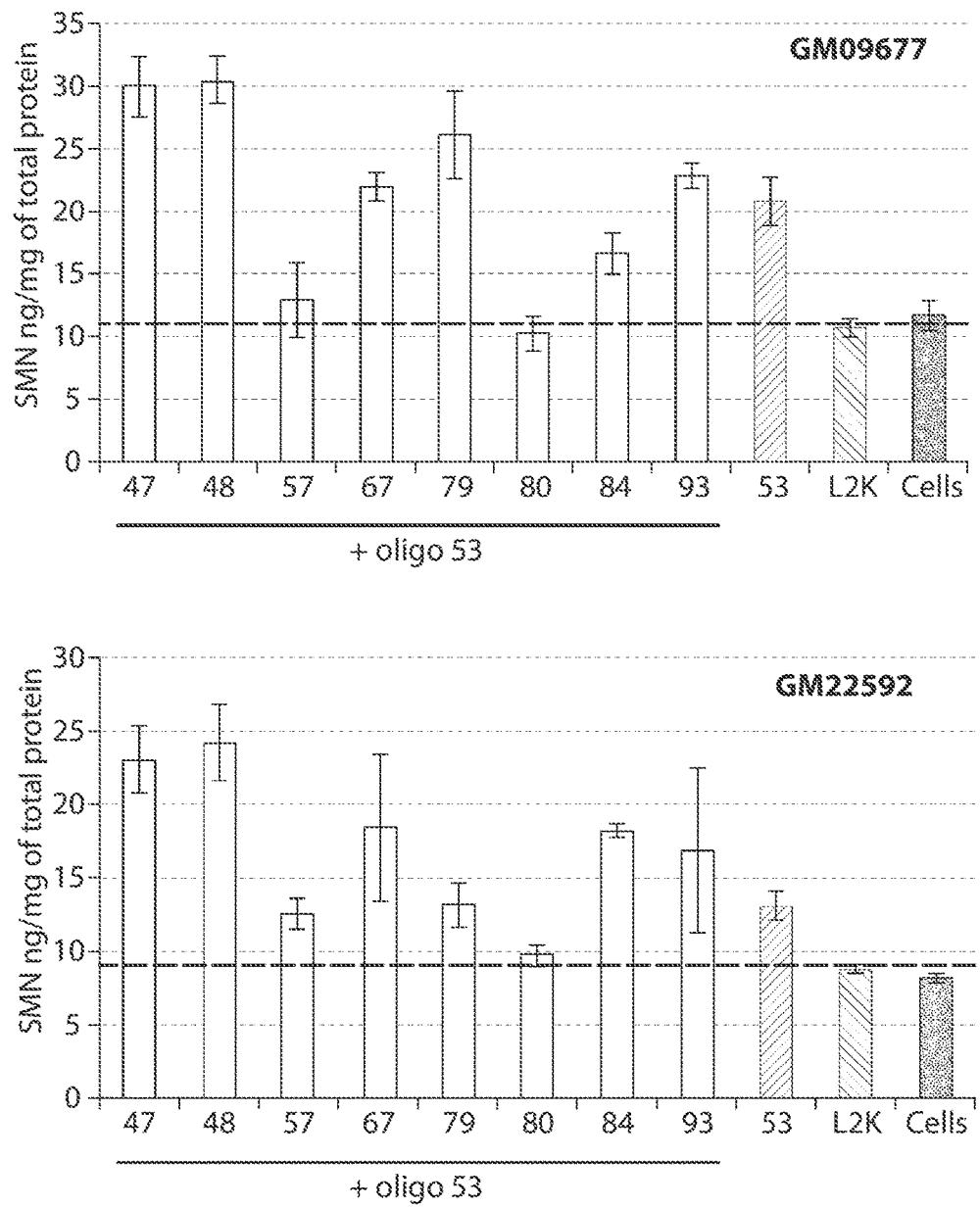
Figures 1, 8:
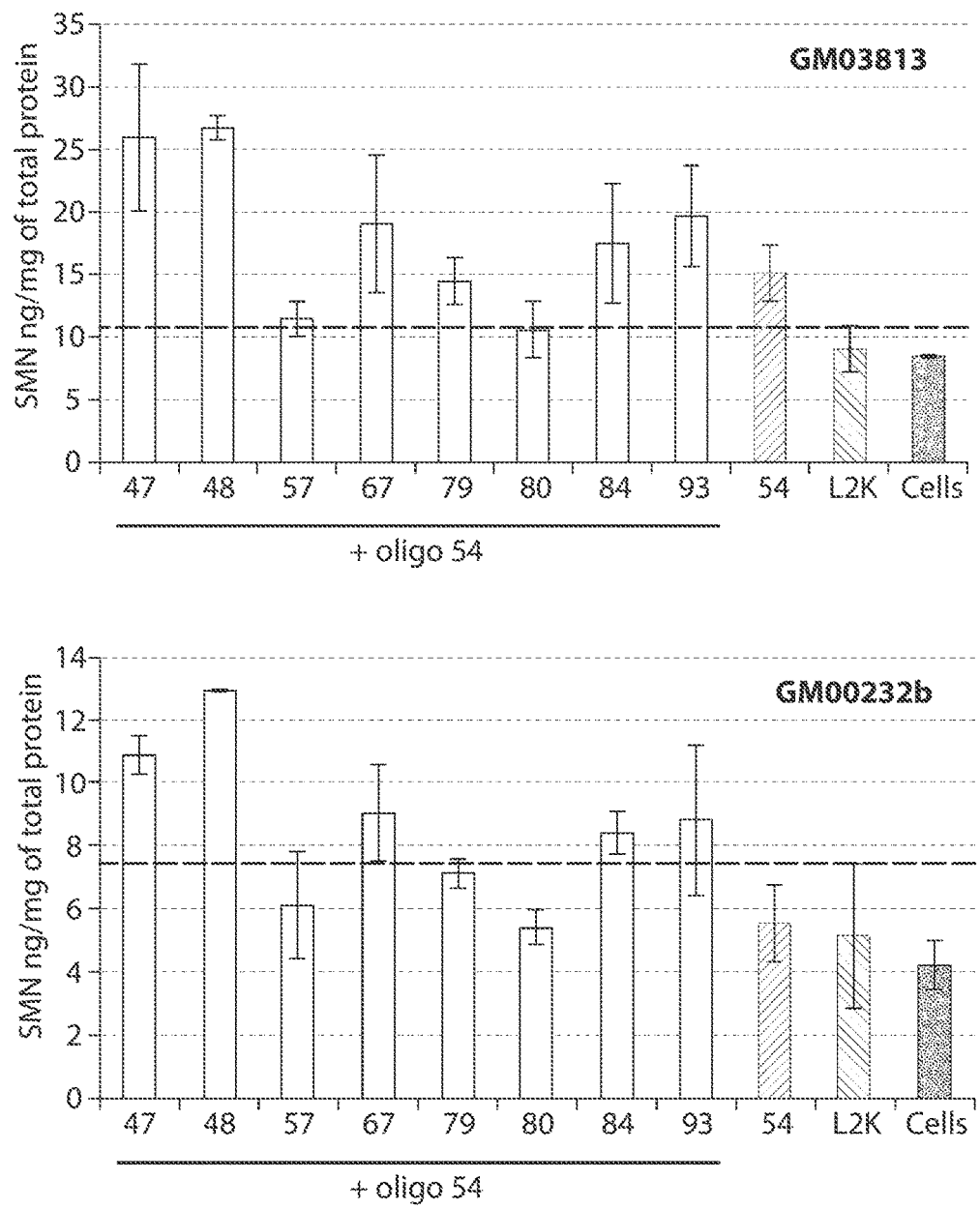
FIG. 8 provides results of an SMN ELISA showing that oligonucleotides directed against a PRC2-associated region of SMN2 in combination with a splice switching oligonucleotide (oligo 54) significantly increase SMN2 protein 24 h post-transfection in SMA patient fibroblasts (compared to Lipofectamine treated cells—dashed line).
Figures 2, 8:
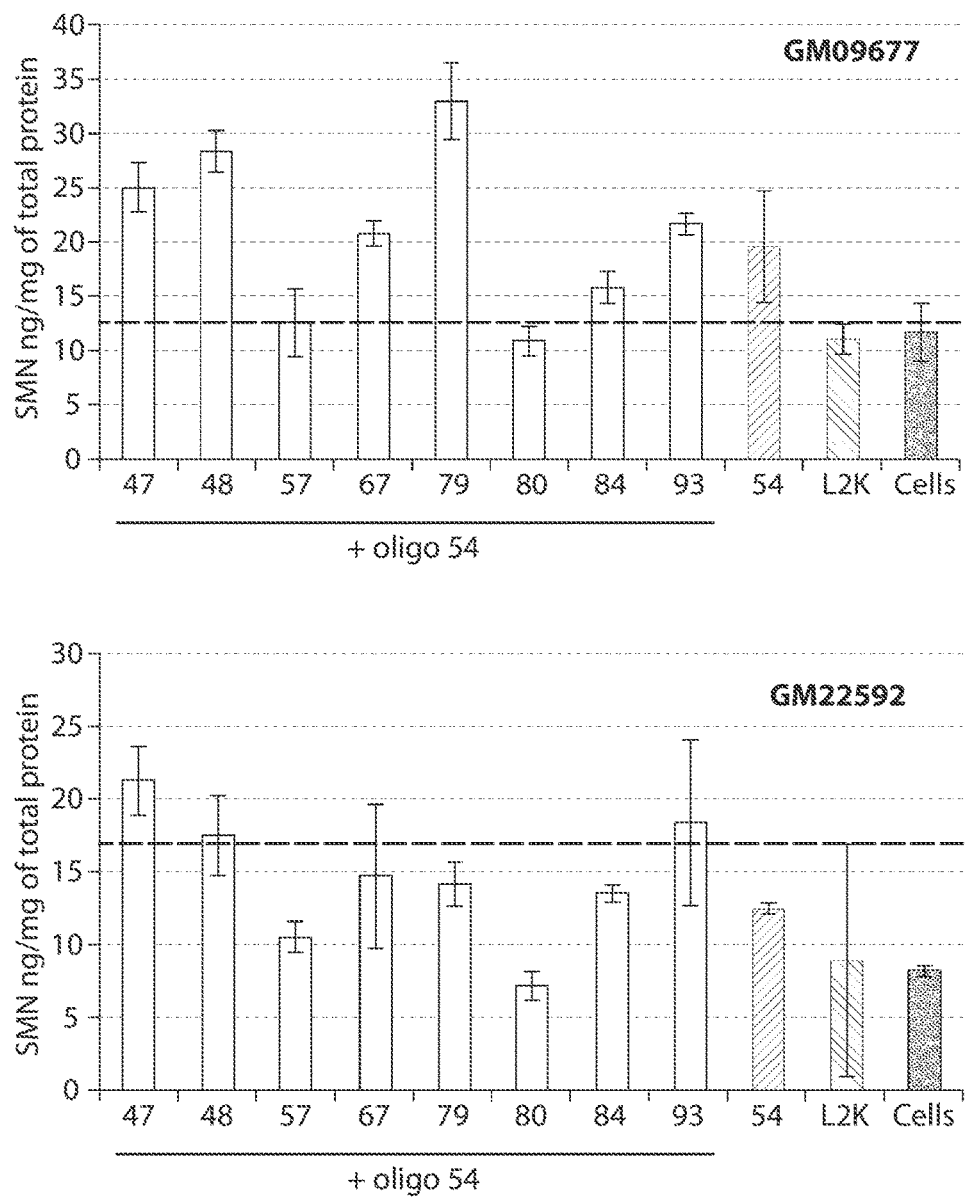
Figure 9:
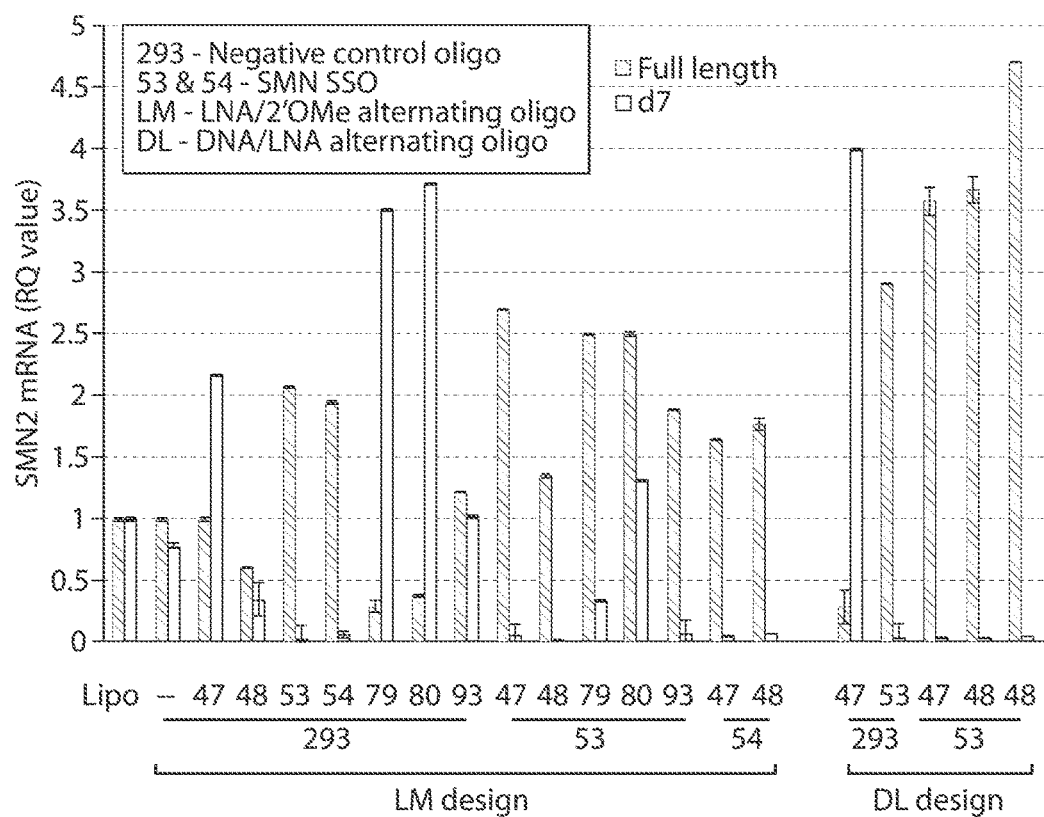
FIG. 9 provides results of an RT-PCR assay showing that oligonucleotides directed against a PRC2-associated region of SMN2 in combination with a splice switching oligonucleotide (oligo 53 or 54) significantly increase SMN2 protein 24 h post-transfection in SMA patient fibroblasts (compared to negative control oligo and Lipofectamine treated cells). LNA/2'OMe alternating oligonucleotide (LM design) and DNA/LNA alternating oligonucleotides (DL design) were tested.

SMN ELISA (Enzo) assays were conducted and revealed that certain oligonucleotides directed against a PRC2-associated region of SMN2 alone did not significantly increase full length SMN protein 24 h post-transfection in certain SMA patient fibroblasts. (FIG. 6) However, the same SMN ELISA assays showed that oligonucleotides directed against a PRC2-associated region of SMN2 in combination with a splice switching oligonucleotide (oligo 53 or 54) significantly increase full length SMN protein 24 h post-transfection in SMA patient fibroblasts above that observed with splice switching oligonucleotides alone. (FIGS. 7 and 8). RT-PCR assays were conducted and showed that oligonucleotides directed against a PRC2-associated region of SMN2 in combination with a splice switching oligonucleotide (oligo 53 or 54) significantly increased SMN2 protein 24 h post-transfection in SMA patient fibroblasts. (FIG. 9.) These experiments were conducted modified oligonucleotides with either alternating LNA and 2'OMe nucleotides or alternating DNA and LNA nucleotides.

In summary, the results of Example 2 show that certain oligos targeting PRC2 associated regions of SMN2 induce SMN RNA expression (e.g., of the SMNΔ7 transcript) SMA patient-derived fibroblasts. The results also show that, in some embodiments, splice-switching oligos may not induce SMN RNA expression, but rather shift SMN RNA splicing to the full-length transcript. Finally, the results show that combination of splice switching oligos with PRC2-associated region targeting oligos substantially increases full length SMN protein in cells from SMA patients.

TABLE 4

Oligonucleotide sequences made for testing human cells obtained from subjects with Spinal Muscular Atrophy (See Table 3 for structural features of formatted sequence).

| Oligo Name | Base Sequence | Formatted Sequence | SeqID |
|---|---|---|---|
| SMN1-01 m03 | ATTCTCTTGA TGATGCTGAT | omeAs;omeUs;omeUs;omeCs;omeUs;omeCs;omeUs;omeUs;omeGs;omeAs; omeUs;omeGs;omeAs;omeUs;omeGs;omeCs;omeUs;omeGs;omeAs; omeU-Sup | 13062 |
| SMN1-02 m03 | TTCTCTTGAT GATGCTGAT G | omeUs;omeUs;omeCs;omeUs;omeCs;omeUs;omeUs;omeGs;omeAs;omeUs; omeGs;omeAs;omeUs;omeGs;omeCs;omeUs;omeGs;omeAs;omeUs; omeG-Sup | 13063 |
| SMN1-03 m03 | TCTCTTGATG ATGCTGATGC | omeUs;omeCs;omeUs;omeCs;omeUs;omeUs;omeGs;omeAs;omeUs;omeGs; omeAs;omeUs;omeGs;omeCs;omeUs;omeGs;omeAs;omeUs;omeGs; omeC-Sup | 13064 |
| SMN1-04 m03 | CTCTTGATGA TGCTGATGCT | omeCs;omeUs;omeCs;omeUs;omeUs;omeGs;omeAs;omeUs;omeGs;omeAs; omeUs;omeGs;omeCs;omeUs;omeGs;omeAs;omeUs;omeGs;omeCs; omeU-Sup | 13065 |

TABLE 4 -continued

Oligonucleotide sequences made for testing human cells obtained from subjects with Spinal Muscular Atrophy (See Table 3 for structural features of formatted sequence).

| Oligo Name | Base Sequence | Formatted Sequence | SeqID |
|---|---|---|---|
| SMN1-05 m03 | TCTTGATGATGCTGATGCTT | omeUs;omeCs;omeUs;omeUs;omeGs;omeAs;omeUs;omeGs;omeAs;omeUs;omeGs;omeCs;omeUs;omeGs;omeAs;omeUs;omeGs;omeCs;omeUs;omeU-Sup | 13066 |
| SMN1-06 m03 | CTTGATGATGCTGATGCTTT | omeCs;omeUs;omeUs;omeGs;omeAs;omeUs;omeGs;omeAs;omeUs;omeGs;omeCs;omeUs;omeGs;omeAs;omeUs;omeGs;omeCs;omeUs;omeUs;omeU-Sup | 13067 |
| SMN1-07 m03 | TTGATGATGCTGATGCTTTG | omeUs;omeUs;omeGs;omeAs;omeUs;omeGs;omeAs;omeUs;omeGs;omeCs;omeUs;omeGs;omeAs;omeUs;omeGs;omeCs;omeUs;omeUs;omeUs;omeG-Sup | 13068 |
| SMN1-08 m03 | TGATGATGCTGATGCTTTGG | omeUs;omeGs;omeAs;omeUs;omeGs;omeAs;omeUs;omeGs;omeCs;omeUs;omeGs;omeAs;omeUs;omeGs;omeCs;omeUs;omeUs;omeUs;omeGs;omeG-Sup | 13069 |
| SMN1-09 m03 | GATGATGCTGATGCTTTGGG | omeGs;omeAs;omeUs;omeGs;omeAs;omeUs;omeGs;omeCs;omeUs;omeGs;omeAs;omeUs;omeGs;omeCs;omeUs;omeUs;omeUs;omeGs;omeGs;omeG-Sup | 13070 |
| SMN1-10 m03 | ATGATGCTGATGCTTTGGGA | omeAs;omeUs;omeGs;omeAs;omeUs;omeGs;omeCs;omeUs;omeGs;omeAs;omeUs;omeGs;omeCs;omeUs;omeUs;omeUs;omeGs;omeGs;omeGs;omeA-Sup | 13071 |
| SMN1-11 m03 | TGATGCTGATGCTTTGGGAA | omeUs;omeGs;omeAs;omeUs;omeGs;omeCs;omeUs;omeGs;omeAs;omeUs;omeGs;omeCs;omeUs;omeUs;omeUs;omeGs;omeGs;omeGs;omeAs;omeA-Sup | 13072 |
| SMN1-12 m03 | GATGCTGATGCTTTGGGAAG | omeGs;omeAs;omeUs;omeGs;omeCs;omeUs;omeGs;omeAs;omeUs;omeGs;omeCs;omeUs;omeUs;omeUs;omeGs;omeGs;omeGs;omeAs;omeAs;omeG-Sup | 13073 |
| SMN1-13 m03 | ATGCTGATGCTTTGGGAAGT | omeAs;omeUs;omeGs;omeCs;omeUs;omeGs;omeAs;omeUs;omeGs;omeCs;omeUs;omeUs;omeUs;omeGs;omeGs;omeGs;omeAs;omeAs;omeGs;omeU-Sup | 13074 |
| SMN1-14 m03 | TGCTGATGCTTTGGGAAGTA | omeUs;omeGs;omeCs;omeUs;omeGs;omeAs;omeUs;omeGs;omeCs;omeUs;omeUs;omeUs;omeGs;omeGs;omeGs;omeAs;omeAs;omeGs;omeUs;omeA-Sup | 13075 |
| SMN1-15 m03 | GCTGATGCTTTGGGAAGTAT | omeGs;omeCs;omeUs;omeGs;omeAs;omeUs;omeGs;omeCs;omeUs;omeUs;omeUs;omeGs;omeGs;omeGs;omeAs;omeAs;omeGs;omeUs;omeAs;omeU-Sup | 13076 |
| SMN1-16 m03 | CTGATGCTTTGGGAAGTATG | omeCs;omeUs;omeGs;omeAs;omeUs;omeGs;omeCs;omeUs;omeUs;omeUs;omeGs;omeGs;omeGs;omeAs;omeAs;omeGs;omeUs;omeAs;omeUs;omeG-Sup | 13077 |
| SMN1-17 m03 | TGATGCTTTGGGAAGTATGT | omeUs;omeGs;omeAs;omeUs;omeGs;omeCs;omeUs;omeUs;omeUs;omeGs;omeGs;omeGs;omeAs;omeAs;omeGs;omeUs;omeAs;omeUs;omeGs;omeU-Sup | 13078 |
| SMN1-18 m03 | GATGCTTTGGGAAGTATGTT | omeGs;omeAs;omeUs;omeGs;omeCs;omeUs;omeUs;omeUs;omeGs;omeGs;omeGs;omeAs;omeAs;omeGs;omeUs;omeAs;omeUs;omeGs;omeUs;omeU-Sup | 13079 |
| SMN1-19 m03 | ATGCTTTGGGAAGTATGTTA | omeAs;omeUs;omeGs;omeCs;omeUs;omeUs;omeUs;omeGs;omeGs;omeGs;omeAs;omeAs;omeGs;omeUs;omeAs;omeUs;omeGs;omeUs;omeUs;omeA-Sup | 13080 |
| SMN1-20 m03 | TGCTTTGGGAAGTATGTTAA | omeUs;omeGs;omeCs;omeUs;omeUs;omeUs;omeGs;omeGs;omeGs;omeAs;omeAs;omeGs;omeUs;omeAs;omeUs;omeGs;omeUs;omeUs;omeAs;omeA-Sup | 13081 |
| SMN1-21 m03 | GCTTTGGGAAGTATGTTAAT | omeGs;omeCs;omeUs;omeUs;omeUs;omeGs;omeGs;omeGs;omeAs;omeAs;omeGs;omeUs;omeAs;omeUs;omeGs;omeUs;omeUs;omeAs;omeAs;omeU-Sup | 13082 |
| SMN1-22 m03 | CTTTGGGAAGTATGTTAATT | omeCs;omeUs;omeUs;omeUs;omeGs;omeGs;omeGs;omeAs;omeAs;omeGs;omeUs;omeAs;omeUs;omeGs;omeUs;omeUs;omeAs;omeAs;omeUs;omeU-Sup | 13083 |

TABLE 4 -continued

Oligonucleotide sequences made for testing human cells obtained from subjects with Spinal Muscular Atrophy (See Table 3 for structural features of formatted sequence).

| Oligo Name | Base Sequence | Formatted Sequence | SeqID |
|---|---|---|---|
| SMN1-23 m03 | TTTGGGAAGT ATGTTAATTT | omeUs;omeUs;omeUs;omeGs;omeGs;omeGs;omeAs;omeAs;omeGs;omeUs; omeAs;omeUs;omeGs;omeUs;omeUs;omeAs;omeAs;omeUs;omeUs; omeU-Sup | 13084 |
| SMN1-24 m03 | TTGGGAAGT ATGTTAATTT C | omeUs;omeUs;omeGs;omeGs;omeGs;omeAs;omeAs;omeGs;omeUs;omeAs; omeUs;omeGs;omeUs;omeUs;omeAs;omeAs;omeUs;omeUs;omeUs; omeC-Sup | 13085 |
| SMN1-25 m03 | TGGGAAGTA TGTTAATTTC A | omeUs;omeGs;omeGs;omeGs;omeAs;omeAs;omeGs;omeUs;omeAs;omeUs; omeGs;omeUs;omeUs;omeAs;omeAs;omeUs;omeUs;omeUs;omeCs; omeA-Sup | 13086 |
| SMN1-26 m03 | GGGAAGTAT GTTAATTTCA T | omeGs;omeGs;omeGs;omeAs;omeAs;omeGs;omeUs;omeAs;omeUs;omeGs; omeUs;omeUs;omeAs;omeAs;omeUs;omeUs;omeUs;omeCs;omeAs; omeU-Sup | 13087 |
| SMN1-27 m01 | ATTCTCTTGA TGATG | lnaAs;omeUs;lnaTs;omeCs;lnaTs;omeCs;lnaTs;omeUs;lnaGs;omeAs; lnaTs;omeGs;lnaAs;omeUs;lnaG-Sup | 11374 |
| SMN1-28 m01 | TTCTCTTGAT GATGC | lnaTs;omeUs;lnaCs;omeUs;lnaCs;omeUs;lnaTs;omeGs;lnaAs;omeUs; lnaGs;omeAs;lnaTs;omeGs;lnaC-Sup | 11375 |
| SMN1-29 m01 | TCTCTTGATG ATGCT | lnaTs;omeCs;lnaTs;omeCs;lnaTs;omeUs;lnaGs;omeAs;lnaTs;omeGs;lnaAs; omeUs;lnaGs;omeCs;lnaT-Sup | 11376 |
| SMN1-30 m01 | CTCTTGATGA TGCTG | lnaCs;omeUs;lnaCs;omeUs;lnaTs;omeGs;lnaAs;omeUs;lnaGs;omeAs;lnaTs; omeGs;lnaCs;omeUs;lnaG-Sup | 11377 |
| SMN1-31 m01 | TCTTGATGAT GCTGA | lnaTs;omeCs;lnaTs;omeUs;lnaGs;omeAs;lnaTs;omeGs;lnaAs;omeUs;lnaGs; omeCs;lnaTs;omeGs;lnaA-Sup | 11378 |
| SMN1-32 m01 | CTTGATGATG CTGAT | lnaCs;omeUs;lnaTs;omeGs;lnaAs;omeUs;lnaGs;omeAs;lnaTs;omeGs;lnaCs; omeUs;lnaGs;omeAs;lnaT-Sup | 11379 |
| SMN1-33 m01 | TTGATGATGC TGATG | lnaTs;omeUs;lnaGs;omeAs;lnaTs;omeGs;lnaAs;omeUs;lnaGs;omeCs;lnaTs; omeGs;lnaAs;omeUs;lnaG-Sup | 11380 |
| SMN1-34 m01 | TGATGATGCT GATGC | lnaTs;omeGs;lnaAs;omeUs;lnaGs;omeAs;lnaTs;omeGs;lnaCs;omeUs;lnaGs; omeAs;lnaTs;omeGs;lnaC-Sup | 11381 |
| SMN1-35 m01 | GATGATGCT GATGCT | lnaGs;omeAs;lnaTs;omeGs;lnaAs;omeUs;lnaGs;omeCs;lnaTs;omeGs;lnaAs; omeUs;lnaGs;omeCs;lnaT-Sup | 11382 |
| SMN1-36 m01 | ATGATGCTGA TGCTT | lnaAs;omeUs;lnaGs;omeAs;lnaTs;omeGs;lnaCs;omeUs;lnaGs;omeAs;lnaTs; omeGs;lnaCs;omeUs;lnaT-Sup | 11383 |
| SMN1-37 m01 | TGATGCTGAT GCTTT | lnaTs;omeGs;lnaAs;omeUs;lnaGs;omeCs;lnaTs;omeGs;lnaAs;omeUs;lnaGs; omeCs;lnaTs;omeUs;lnaT-Sup | 11384 |
| SMN1-38 m01 | GATGCTGAT GCTTTG | lnaGs;omeAs;lnaTs;omeGs;lnaCs;omeUs;lnaGs;omeAs;lnaTs;omeGs;lnaCs; omeUs;lnaTs;omeUs;lnaG-Sup | 11385 |
| SMN1-39 m01 | ATGCTGATGC TTTGG | lnaAs;omeUs;lnaGs;omeCs;lnaTs;omeGs;lnaAs;omeUs;lnaGs;omeCs;lnaTs; omeUs;lnaTs;omeGs;lnaG-Sup | 11386 |
| SMN1-40 m01 | TGCTGATGCT TTGGG | lnaTs;omeGs;lnaCs;omeUs;lnaGs;omeAs;lnaTs;omeGs;lnaCs;omeUs;lnaTs; omeUs;lnaGs;omeGs;lnaG-Sup | 11387 |
| SMN1-41 m01 | GCTGATGCTT TGGGA | lnaGs;omeCs;lnaTs;omeGs;lnaAs;omeUs;lnaGs;omeCs;lnaTs;omeUs;lnaTs; omeGs;lnaGs;omeGs;lnaA-Sup | 11388 |
| SMN1-42 m01 | CTGATGCTTT GGGAA | lnaCs;omeUs;lnaGs;omeAs;lnaTs;omeGs;lnaCs;omeUs;lnaTs;omeUs;lnaGs; omeGs;lnaGs;omeAs;lnaA-Sup | 11389 |
| SMN1-43 m01 | TGATGCTTTG GGAAG | lnaTs;omeGs;lnaAs;omeUs;lnaGs;omeCs;lnaTs;omeUs;lnaTs;omeGs;lnaGs; omeGs;lnaAs;omeAs;lnaG-Sup | 11390 |
| SMN1-44 m01 | GATGCTTTGG GAAGT | lnaGs;omeAs;lnaTs;omeGs;lnaCs;omeUs;lnaTs;omeUs;lnaGs;omeGs;lnaGs; omeAs;lnaAs;omeGs;lnaT-Sup | 11391 |
| SMN1-45 m01 | ATGCTTTGGG AAGTA | lnaAs;omeUs;lnaGs;omeCs;lnaTs;omeUs;lnaTs;omeGs;lnaGs;omeGs;lnaAs; omeAs;lnaGs;omeUs;lnaA-Sup | 11392 |

TABLE 4 -continued

Oligonucleotide sequences made for testing human cells obtained from subjects with
Spinal Muscular Atrophy (See Table 3 for structural features of formatted sequence).

| Oligo Name | Base Sequence | Formatted Sequence | SeqID |
|---|---|---|---|
| SMN1-46 m01 | TGCTTTGGGAAGTAT | lnaTs;omeGs;lnaCs;omeUs;lnaTs;omeUs;lnaGs;omeGs;lnaGs;omeAs;lnaAs;omeGs;lnaTs;omeAs;lnaT-Sup | 11393 |
| SMN1-47 m02 | GCTTTGGGAAGTATG | dGs;lnaCs;dTs;lnaTs;dTs;lnaGs;dGs;lnaGs;dAs;lnaAs;dGs;lnaTs;dAs;lnaTs;dG-Sup | 11394 |
| SMN1-47 m01 | GCTTTGGGAAGTATG | lnaGs;omeCs;lnaTs;omeUs;lnaTs;omeGs;lnaGs;omeGs;lnaAs;omeAs;lnaGs;omeUs;lnaAs;omeUs;lnaG-Sup | 11394 |
| SMN1-48 m05 | CTTTGGGAAGTATGT | dCs;lnaTs;dTs;lnaTs;dGs;lnaGs;dGs;lnaAs;dAs;lnaGs;dTs;lnaAs;dTs;lnaGs;dT-Sup | 11395 |
| SMN1-48 m01 | CTTTGGGAAGTATGT | lnaCs;omeUs;lnaTs;omeUs;lnaGs;omeGs;lnaGs;omeAs;lnaAs;omeGs;lnaTs;omeAs;lnaTs;omeGs;lnaT-Sup | 11395 |
| SMN1-49 m01 | TTTGGGAAGTATGTT | lnaTs;omeUs;lnaTs;omeGs;lnaGs;omeGs;lnaAs;omeAs;lnaGs;omeUs;lnaAs;omeUs;lnaGs;omeUs;lnaT-Sup | 11396 |
| SMN1-50 m01 | TTGGGAAGTATGTTA | lnaTs;omeUs;lnaGs;omeGs;lnaGs;omeAs;lnaAs;omeGs;lnaTs;omeAs;lnaTs;omeGs;lnaTs;omeUs;lnaA-Sup | 11397 |
| SMN1-51 m01 | TGGGAAGTATGTTAA | lnaTs;omeGs;lnaGs;omeGs;lnaAs;omeAs;lnaGs;omeUs;lnaAs;omeUs;lnaGs;omeUs;lnaTs;omeAs;lnaA-Sup | 11398 |
| SMN1-52 m01 | GGGAAGTATGTTAAT | lnaGs;omeGs;lnaGs;omeAs;lnaAs;omeGs;lnaTs;omeAs;lnaTs;omeGs;lnaTs;omeUs;lnaAs;omeAs;lnaT-Sup | 11399 |
| SMN1-53 m02 | TCACTTTCATAATGCTGG | dTs;lnaCs;dAs;lnaCs;dTs;lnaTs;dTs;lnaCs;dAs;lnaTs;dAs;lnaAs;dTs;lnaGs;dCs;lnaTs;dGs;lnaG-Sup | 13088 |
| SMN1-53 m12 | TCACTTTCATAATGCTGG | lnaTs;dCs;lnaAs;dCs;lnaTs;dTs;lnaTs;dCs;lnaAs;dTs;lnaAs;dAs;lnaTs;dGs;lnaCs;dTs;lnaGs;dG-Sup | 13088 |
| SMN1-54 m01 | TCACTTTCATAATGCTGG | lnaTs;omeCs;lnaAs;omeCs;lnaTs;omeUs;lnaTs;omeCs;lnaAs;omeUs;lnaAs;omeAs;lnaTs;omeGs;lnaCs;omeUs;lnaGs;omeG-Sup | 13088 |
| SMN1-53 m03 | TCACTTTCATAATGCTGG | omeUs;omeCs;omeAs;omeCs;omeUs;omeUs;omeUs;omeCs;omeAs;omeUs;omeAs;omeAs;omeUs;omeGs;omeCs;omeUs;omeGs;omeG-Sup | 13088 |
| SMN1-55 m01 | TCACTTTCATAATGC | lnaTs;omeCs;lnaAs;omeCs;lnaTs;omeUs;lnaTs;omeCs;lnaAs;omeUs;lnaAs;omeAs;lnaTs;omeGs;lnaC-Sup | 13089 |
| SMN1-56 m01 | CACTTTCATAATGCT | lnaCs;omeAs;lnaCs;omeUs;lnaTs;omeUs;lnaCs;omeAs;lnaTs;omeAs;lnaAs;omeUs;lnaGs;omeCs;lnaT-Sup | 13090 |
| SMN1-57 m02 | ACTTTCATAATGCTG | dAs;lnaCs;dTs;lnaTs;dTs;lnaCs;dAs;lnaTs;dAs;lnaAs;dTs;lnaGs;dCs;lnaTs;dG-Sup | 13091 |
| SMN1-57 m01 | ACTTTCATAATGCTG | lnaAs;omeCs;lnaTs;omeUs;lnaTs;omeCs;lnaAs;omeUs;lnaAs;omeAs;lnaTs;omeGs;lnaCs;omeUs;lnaG-Sup | 13091 |
| SMN1-58 m01 | CTTTCATAATGCTGG | lnaCs;omeUs;lnaTs;omeUs;lnaTs;omeCs;lnaAs;omeUs;lnaAs;omeAs;lnaTs;omeGs;lnaCs;omeUs;lnaG-Sup | 13092 |
| SMN1-59 m01 | AGACCAGTTTTACCT | lnaAs;omeGs;lnaAs;omeCs;lnaCs;omeAs;lnaGs;omeUs;lnaTs;omeUs;lnaTs;omeAs;lnaCs;omeCs;lnaT-Sup | 3650 |
| SMN1-60 m01 | CCTAGCTACTTTGAA | lnaCs;omeCs;lnaTs;omeAs;lnaGs;omeCs;lnaTs;omeAs;lnaCs;omeUs;lnaTs;omeUs;lnaGs;omeAs;lnaA-Sup | 13093 |
| SMN1-61 m01 | TCCTAGCTACTTTGA | lnaTs;omeCs;lnaCs;omeUs;lnaAs;omeGs;lnaCs;omeUs;lnaAs;omeCs;lnaTs;omeUs;lnaTs;omeGs;lnaA-Sup | 13094 |
| SMN1-62 m01 | GAAATATTCCTTATA | lnaGs;omeAs;lnaAs;omeAs;lnaTs;omeAs;lnaTs;omeUs;lnaCs;omeCs;lnaTs;omeUs;lnaAs;omeUs;lnaA-Sup | 10065 |
| SMN1-63 m01 | AAATATTCCTTATAG | lnaAs;omeAs;lnaAs;omeUs;lnaAs;omeUs;lnaTs;omeCs;lnaCs;omeUs;lnaTs;omeAs;lnaTs;omeAs;lnaG-Sup | 10066 |
| SMN1-64 m01 | AATATTCCTTATAGC | lnaAs;omeAs;lnaTs;omeAs;lnaTs;omeUs;lnaCs;omeCs;lnaTs;omeUs;lnaAs;omeUs;lnaAs;omeGs;lnaC-Sup | 10067 |
| SMN1-65 m01 | ATATTCCTTATAGCC | lnaAs;omeUs;lnaAs;omeUs;lnaTs;omeCs;lnaCs;omeUs;lnaTs;omeAs;lnaTs;omeAs;lnaGs;omeCs;lnaC-Sup | 10068 |

TABLE 4 -continued

Oligonucleotide sequences made for testing human cells obtained from subjects with Spinal Muscular Atrophy (See Table 3 for structural features of formatted sequence).

| Oligo Name | Base Sequence | Formatted Sequence | SeqID |
|---|---|---|---|
| SMN1-66 m01 | TATTCCTTATAGCCA | lnaTs;omeAs;lnaTs;omeUs;lnaCs;omeCs;lnaTs;omeUs;lnaAs;omeUs;lnaAs;omeGs;lnaCs;omeCs;lnaA-Sup | 10069 |
| SMN1-67 m01 | ATTCCTTATAGCCAG | lnaAs;omeUs;lnaTs;omeCs;lnaCs;omeUs;lnaTs;omeAs;lnaTs;omeAs;lnaGs;omeCs;lnaCs;omeAs;lnaG-Sup | 10070 |
| SMN1-68 m01 | TTCCTTATAGCCAGG | lnaTs;omeUs;lnaCs;omeCs;lnaTs;omeUs;lnaAs;omeUs;lnaAs;omeGs;lnaCs;omeCs;lnaAs;omeGs;lnaG-Sup | 10071 |
| SMN1-69 m01 | TCCTTATAGCCAGGT | lnaTs;omeCs;lnaCs;omeUs;lnaTs;omeAs;lnaTs;omeAs;lnaGs;omeCs;lnaCs;omeAs;lnaGs;omeGs;lnaT-Sup | 10072 |
| SMN1-70 m01 | CCTTATAGCCAGGTC | lnaCs;omeCs;lnaTs;omeUs;lnaAs;omeUs;lnaAs;omeGs;lnaCs;omeCs;lnaAs;omeGs;lnaGs;omeUs;lnaC-Sup | 10073 |
| SMN1-71 m01 | CTTATAGCCAGGTCT | lnaCs;omeUs;lnaTs;omeAs;lnaTs;omeAs;lnaGs;omeCs;lnaCs;omeAs;lnaGs;omeGs;lnaTs;omeCs;lnaT-Sup | 10074 |
| SMN1-72 m01 | TTATAGCCAGGTCTA | lnaTs;omeUs;lnaAs;omeUs;lnaAs;omeGs;lnaCs;omeCs;lnaAs;omeGs;lnaGs;omeUs;lnaCs;omeUs;lnaA-Sup | 10075 |
| SMN1-73 m01 | GCCAGGTCTAAAATT | lnaGs;omeCs;lnaCs;omeAs;lnaGs;omeGs;lnaTs;omeCs;lnaTs;omeAs;lnaAs;omeAs;lnaAs;omeUs;lnaT-Sup | 10080 |
| SMN1-74 m01 | CCAGGTCTAAAATTC | lnaCs;omeCs;lnaAs;omeGs;lnaGs;omeUs;lnaCs;omeUs;lnaAs;omeAs;lnaAs;omeAs;lnaTs;omeUs;lnaC-Sup | 10081 |
| SMN1-75 m01 | CAGGTCTAAAATTCA | lnaCs;omeAs;lnaGs;omeGs;lnaTs;omeCs;lnaTs;omeAs;lnaAs;omeAs;lnaAs;omeUs;lnaTs;omeCs;lnaA-Sup | 10082 |
| SMN1-76 m01 | GGTCTAAAATTCAAT | lnaGs;omeGs;lnaTs;omeCs;lnaTs;omeAs;lnaAs;omeAs;lnaAs;omeUs;lnaTs;omeCs;lnaAs;omeAs;lnaT-Sup | 10084 |
| SMN1-77 m01 | CTAAAATTCAATGGC | lnaCs;omeUs;lnaAs;omeAs;lnaAs;omeAs;lnaTs;omeUs;lnaCs;omeAs;lnaAs;omeUs;lnaGs;omeGs;lnaC-Sup | 10087 |
| SMN1-77 m03 | CTAAAATTCAATGGC | omeCs;omeUs;omeAs;omeAs;omeAs;omeAs;omeUs;omeUs;omeCs;omeAs;omeAs;omeUs;omeGs;omeGs;omeC-Sup | 10087 |
| SMN1-78 m01 | GGACCACCAGTAAGT | lnaGs;omeGs;lnaAs;omeCs;lnaCs;omeAs;lnaCs;omeCs;lnaAs;omeGs;lnaTs;omeAs;lnaAs;omeGs;lnaT-Sup | 10168 |
| SMN1-79 m02 | GACCACCAGTAAGTA | dGs;lnaAs;dCs;lnaCs;dAs;lnaCs;dCs;lnaAs;dGs;lnaTs;dAs;lnaAs;dGs;lnaTs;dA-Sup | 10169 |
| SMN1-79 m01 | GACCACCAGTAAGTA | lnaGs;omeAs;lnaCs;omeCs;lnaAs;omeCs;lnaCs;omeAs;lnaGs;omeUs;lnaAs;omeAs;lnaGs;omeUs;lnaA-Sup | 10169 |
| SMN1-80 m02 | ACCACCAGTAAGTAA | dAs;lnaCs;dCs;lnaAs;dCs;lnaCs;dAs;lnaGs;dTs;lnaAs;dAs;lnaGs;dTs;lnaAs;dA-Sup | 10170 |
| SMN1-80 m01 | ACCACCAGTAAGTAA | lnaAs;omeCs;lnaCs;omeAs;lnaCs;omeCs;lnaAs;omeGs;lnaTs;omeAs;lnaAs;omeGs;lnaTs;omeAs;lnaA-Sup | 10170 |
| SMN1-81 m01 | TTCTGTTACCCAGAT | lnaTs;omeUs;lnaCs;omeUs;lnaGs;omeUs;lnaTs;omeAs;lnaCs;omeCs;lnaCs;omeAs;lnaGs;omeAs;lnaT-Sup | 10337 |
| SMN1-82 m01 | TCTGTTACCCAGATG | lnaTs;omeCs;lnaTs;omeGs;lnaTs;omeUs;lnaAs;omeCs;lnaCs;omeCs;lnaAs;omeGs;lnaAs;omeUs;lnaG-Sup | 10338 |
| SMN1-83 m01 | CTGTTACCCAGATGC | lnaCs;omeUs;lnaGs;omeUs;lnaTs;omeAs;lnaCs;omeCs;lnaCs;omeAs;lnaGs;omeAs;lnaTs;omeGs;lnaC-Sup | 10339 |
| SMN1-84 m02 | TTTTTAGGTATTAAC | dTs;lnaTs;dTs;lnaTs;dTs;lnaAs;dGs;lnaGs;dTs;lnaAs;dTs;lnaTs;dAs;lnaAs;dC-Sup | 10763 |
| SMN1-84 m01 | TTTTTAGGTATTAAC | lnaTs;omeUs;lnaTs;omeUs;lnaTs;omeUs;lnaAs;omeGs;lnaGs;omeUs;lnaAs;omeUs;lnaTs;omeAs;omeAs;lnaC-Sup | 10763 |
| SMN1-85 m01 | TTTTAGGTATTAACA | lnaTs;omeUs;lnaTs;omeUs;lnaUs;omeGs;lnaGs;omeUs;lnaAs;omeUs;lnaTs;omeAs;lnaAs;omeCs;lnaA-Sup | 10764 |

TABLE 4 -continued

Oligonucleotide sequences made for testing human cells obtained from subjects with Spinal Muscular Atrophy (See Table 3 for structural features of formatted sequence).

| Oligo Name | Base Sequence | Formatted Sequence | SeqID |
|---|---|---|---|
| SMN1-86 m01 | CATAGCTTCATAGTG | lnaCs;omeAs;lnaTs;omeAs;lnaGs;omeCs;lnaTs;omeUs;lnaCs;omeAs;lnaTs;omeAs;lnaGs;omeUs;lnaG-Sup | 10949 |
| SMN1-87 m01 | TAGCTTCATAGTGGA | lnaTs;omeAs;lnaGs;omeCs;lnaTs;omeUs;lnaCs;omeAs;lnaTs;omeAs;lnaGs;omeUs;lnaGs;omeGs;lnaA-Sup | 10951 |
| SMN1-88 m01 | AGCTTCATAGTGGAA | lnaAs;omeGs;lnaCs;omeUs;lnaTs;omeCs;lnaAs;omeUs;lnaAs;omeGs;lnaTs;omeGs;lnaGs;omeAs;lnaA-Sup | 10952 |
| SMN1-89 m01 | GCTTCATAGTGGAAC | lnaGs;omeCs;lnaTs;omeUs;lnaCs;omeAs;lnaTs;omeAs;lnaGs;omeUs;lnaGs;omeGs;lnaAs;omeAs;lnaC-Sup | 10953 |
| SMN1-90 m01 | CTTCATAGTGGAACA | lnaCs;omeUs;lnaTs;omeCs;lnaAs;omeUs;lnaAs;omeGs;lnaTs;omeGs;lnaGs;omeAs;lnaAs;omeCs;lnaA-Sup | 10954 |
| SMN1-91 m01 | TCATGGTACATGAGT | lnaTs;omeCs;lnaAs;omeUs;lnaGs;omeGs;lnaTs;omeAs;lnaCs;omeAs;lnaTs;omeGs;lnaAs;omeGs;lnaT-Sup | 11415 |
| SMN1-92 m01 | TGGTACATGAGTGGC | lnaTs;omeGs;lnaGs;omeUs;lnaAs;omeCs;lnaAs;omeUs;lnaGs;omeAs;lnaGs;omeUs;lnaGs;omeGs;lnaC-Sup | 11418 |
| SMN1-93 m02 | GGTACATGAGTGGCT | dGs;lnaGs;dTs;lnaAs;dCs;lnaAs;dTs;lnaGs;dAs;lnaGs;dTs;lnaGs;dGs;lnaCs;dT-Sup | 11419 |
| SMN1-93 m01 | GGTACATGAGTGGCT | lnaGs;omeGs;lnaTs;omeAs;lnaCs;omeAs;lnaTs;omeGs;lnaAs;omeGs;lnaTs;omeGs;lnaGs;omeCs;lnaT-Sup | 11419 |
| SMN1-94 m01 | TACATGAGTGGCTAT | lnaTs;omeAs;lnaCs;omeAs;lnaTs;omeGs;lnaAs;omeGs;lnaTs;omeGs;lnaGs;omeCs;lnaTs;omeAs;lnaT-Sup | 11421 |
| SMN1-95 m01 | ACATGAGTGGCTATC | lnaAs;omeCs;lnaAs;omeUs;lnaGs;omeAs;lnaGs;omeUs;lnaGs;omeGs;lnaCs;omeUs;lnaAs;omeUs;lnaC-Sup | 11422 |
| SMN1-96 m01 | CATGAGTGGCTATCA | lnaCs;omeAs;lnaTs;omeGs;omeGs;lnaGs;omeGs;lnaCs;lnaTs;omeAs;lnaTs;omeCs;lnaA-Sup | 11423 |
| SMN1-97 m01 | CTGGCTATTATATGG | lnaCs;omeUs;lnaGs;omeGs;lnaCs;omeUs;lnaAs;omeUs;lnaTs;omeAs;lnaTs;omeAs;lnaTs;omeGs;lnaG-Sup | 11440 |
| SMN1-98 m01 | TGGCTATTATATGGT | lnaTs;omeGs;lnaGs;omeCs;lnaTs;omeAs;lnaTs;omeUs;lnaAs;omeUs;lnaAs;omeUs;lnaGs;omeGs;lnaT-Sup | 11441 |
| SMN1-99 m01 | GGCTATTATATGGTA | lnaGs;omeGs;lnaCs;omeUs;lnaAs;omeUs;lnaAs;omeAs;lnaTs;omeAs;lnaTs;omeGs;lnaGs;omeUs;lnaA-Sup | 11442 |
| SMN1-100 m01 | GCTATTATATGGTAA | lnaGs;omeCs;lnaTs;omeAs;lnaTs;omeUs;lnaAs;omeUs;lnaAs;omeUs;lnaGs;omeGs;lnaTs;omeAs;lnaA-Sup | 11443 |
| SMN1-101 m01 | GTATCATCTGTGTGT | lnaGs;omeUs;lnaAs;omeUs;lnaCs;omeAs;lnaTs;omeCs;lnaTs;omeGs;lnaTs;omeGs;lnaTs;omeGs;lnaT-Sup | 12369 |
| SMN1-102 m01 | GCTTTGGGAAGTATGTTTTTCACTTTCATAATGCTGG | lnaGs;omeCs;lnaTs;omeUs;lnaTs;omeGs;lnaGs;omeGs;lnaAs;omeAs;lnaGs;omeUs;lnaAs;omeUs;lnaG;dT;dT;dT;dT;lnaTs;omeCs;lnaAs;omeCs;lnaTs;omeUs;lnaTs;omeCs;lnaAs;omeUs;lnaAs;omeAs;lnaTs;omeGs;lnaCs;omeUs;lnaGs;omeG-Sup | 13097 |
| SMN1-103 m01 | CTTTGGGAAGTATGTTTTTCACTTTCATAATGCTGG | lnaCs;omeUs;lnaTs;omeUs;lnaTs;omeGs;lnaGs;omeGs;lnaAs;omeAs;lnaGs;omeUs;lnaAs;lnaTs;omeGs;lnaT;dT;dT;dT;dT;lnaTs;omeCs;lnaAs;omeCs;lnaTs;omeUs;lnaTs;omeCs;lnaAs;omeUs;lnaAs;omeAs;lnaTs;omeGs;lnaCs;omeUs;lnaGs;omeG-Sup | 13102 |
| SMN1-104 m01 | GGTACATGAGTGGCTTTTTTCACTTTCATAATGCTGG | lnaGs;omeGs;lnaTs;omeAs;lnaCs;omeAs;lnaTs;omeGs;lnaAs;omeGs;lnaTs;omeGs;lnaGs;omeCs;lnaT;dT;dT;dT;dT;lnaTs;omeCs;lnaAs;omeCs;lnaTs;omeUs;lnaTs;omeCs;lnaAs;omeUs;lnaAs;omeAs;lnaTs;omeGs;lnaCs;omeUs;lnaGs;omeG-Sup | 13099 |
| SMN1-105 m01 | TGATGCTGATGCTTTTTTTCTAAAATTCAATGGC | lnaTs;omeGs;lnaAs;omeUs;lnaGs;omeCs;lnaUs;omeGs;lnaAs;omeUs;lnaGs;omeCs;lnaTs;omeUs;lnaT;dT;dT;dT;dT;lnaCs;omeUs;lnaAs;omeAs;lnaAs;omeAs;lnaTs;omeUs;lnaCs;omeAs;lnaAs;omeUs;lnaGs;omeGs;lnaC-Sup | 13103 |
| SMN1-106 m01 | CTAAAATTCAATGGCTTTTC | lnaCs;omeUs;lnaAs;omeAs;lnaAs;omeAs;lnaTs;omeUs;lnaCs;omeAs;lnaAs;omeUs;lnaGs;omeGs;lnaC;dT;dT;dT;dT;lnaCs;omeUs;lnaAs;omeAs;lnaAs; | 13104 |

TABLE 4 -continued

Oligonucleotide sequences made for testing human cells obtained from subjects with Spinal Muscular Atrophy (See Table 3 for structural features of formatted sequence).

| Oligo Name | Base Sequence | Formatted Sequence | SeqID |
|---|---|---|---|
| | TAAAATTCAATGGC | omeAs;lnaTs;omeUs;lnaCs;omeAs;lnaAs;omeUs;lnaGs;omeGs;lnaC-Sup | |
| SMN1-107 m01 | CTGTTACCCAGATGCTTTTCTAAAATTCAATGGC | lnaCs;omeUs;lnaGs;omeUs;lnaTs;omeAs;lnaCs;omeCs;lnaCs;omeAs;lnaGs;omeAs;lnaTs;omeGs;lnaC;dT;dT;dT;dT;lnaCs;omeUs;lnaAs;omeAs;lnaAs;omeAs;lnaTs;omeUs;lnaCs;omeAs;lnaAs;omeUs;lnaGs;omeGs;lnaC-Sup | 13105 |
| SMN1-108 m01 | CTTCATAGTGGAACATTTTCTAAAATTCAATGGC | lnaCs;omeUs;lnaTs;omeCs;lnaAs;omeUs;lnaAs;omeGs;lnaTs;omeGs;lnaGs;omeAs;lnaAs;omeCs;lnaA;dT;dT;dT;dT;lnaCs;omeUs;lnaAs;omeAs;lnaAs;omeAs;lnaTs;omeUs;lnaCs;omeAs;lnaAs;omeUs;lnaGs;omeGs;lnaC-Sup | 13106 |
| SMN1-109 m01 | TCACTTTCATAATGCTGGTTTTCACTTTCATAATGCTGG | lnaTs;omeCs;lnaAs;omeCs;lnaTs;omeUs;lnaTs;omeCs;lnaAs;omeUs;lnaAs;omeAs;lnaTs;omeGs;lnaCs;omeUs;lnaGs;omeG;dT;dT;dT;dT;lnaTs;omeCs;lnaAs;omeCs;lnaTs;omeUs;lnaTs;omeCs;lnaAs;omeUs;lnaAs;omeAs;lnaTs;omeGs;lnaCs;omeUs;lnaGs;omeG-Sup | 13107 |
| SMN1-110 m01 | AAATTCAATGGCCCA | lnaAs;omeAs;lnaAs;omeUs;lnaTs;omeCs;lnaAs;omeAs;lnaTs;omeGs;lnaGs;omeCs;lnaCs;omeCs;lnaA-Sup | 10090 |
| SMN1-111 m01 | AATTCAATGGCCCAC | lnaAs;omeAs;lnaTs;omeUs;lnaCs;omeAs;lnaAs;omeUs;lnaGs;omeGs;lnaCs;omeCs;lnaCs;omeAs;lnaC-Sup | 10091 |
| SMN1-112 m01 | ATTCAATGGCCCACC | lnaAs;omeUs;lnaTs;omeCs;lnaAs;omeAs;lnaTs;omeGs;lnaGs;omeCs;lnaCs;omeCs;lnaAs;omeCs;lnaC-Sup | 10092 |
| SMN1-113 m01 | TTCAATGGCCCACCA | lnaTs;omeUs;lnaCs;omeAs;lnaAs;omeUs;lnaGs;omeGs;lnaCs;omeCs;lnaCs;omeAs;lnaCs;omeCs;lnaA-Sup | 10093 |
| SMN1-114 m01 | TCAATGGCCCACCAC | lnaTs;omeCs;lnaAs;omeAs;lnaTs;omeGs;lnaGs;omeCs;lnaCs;omeCs;lnaAs;omeCs;lnaCs;omeAs;lnaC-Sup | 10094 |
| SMN1-115 m01 | CAATGGCCCACCACC | lnaCs;omeAs;lnaAs;omeUs;lnaGs;omeGs;lnaCs;omeCs;lnaCs;omeAs;lnaCs;omeCs;lnaAs;omeCs;lnaC-Sup | 10095 |
| SMN1-116 m01 | AATGGCCCACCACCG | lnaAs;omeAs;lnaTs;omeGs;lnaGs;omeCs;lnaCs;omeCs;lnaAs;omeCs;lnaCs;omeAs;lnaCs;omeCs;lnaG-Sup | 10096 |
| SMN1-117 m01 | ATGGCCCACCACCGC | lnaAs;omeUs;lnaGs;omeGs;lnaCs;omeCs;lnaCs;omeAs;lnaCs;omeCs;lnaAs;omeCs;lnaCs;omeGs;lnaC-Sup | 10097 |
| SMN1-118 m01 | AATGCCTTTCTGTTA | lnaAs;omeAs;lnaTs;omeGs;lnaCs;omeCs;lnaTs;omeUs;lnaTs;omeCs;lnaTs;omeGs;lnaTs;omeUs;lnaA-Sup | 10330 |
| SMN1-119 m01 | ATGCCTTTCTGTTAC | lnaAs;omeUs;lnaGs;omeCs;lnaCs;omeUs;lnaTs;omeUs;lnaTs;omeCs;lnaUs;lnaGs;omeUs;lnaTs;omeAs;lnaC-Sup | 10331 |
| SMN1-120 m01 | TGCCTTTCTGTTACC | lnaTs;omeGs;lnaCs;omeCs;lnaTs;omeUs;lnaTs;omeCs;lnaTs;omeGs;lnaTs;omeUs;lnaAs;omeCs;lnaC-Sup | 10332 |
| SMN1-121 m01 | GCCTTTCTGTTACCC | lnaGs;omeCs;lnaCs;omeUs;lnaTs;omeUs;lnaCs;omeUs;lnaGs;omeUs;lnaTs;omeAs;lnaCs;omeCs;lnaC-Sup | 10333 |
| SMN1-122 m01 | CCTTTCTGTTACCCA | lnaCs;omeCs;lnaTs;omeUs;lnaTs;omeCs;lnaTs;omeGs;lnaTs;omeUs;lnaAs;omeCs;lnaCs;omeCs;lnaA-Sup | 10334 |
| SMN1-123 m01 | CTTTCTGTTACCCAG | lnaCs;omeUs;lnaTs;omeUs;lnaTs;omeCs;lnaUs;lnaGs;omeUs;lnaTs;omeAs;lnaCs;omeCs;lnaCs;omeAs;lnaG-Sup | 10335 |
| SMN1-124 m01 | TTTCTGTTACCCAGA | lnaTs;omeUs;lnaTs;omeCs;lnaTs;omeGs;lnaTs;omeUs;lnaAs;omeCs;lnaCs;omeCs;lnaAs;omeGs;lnaA-Sup | 10336 |
| SMN1-125 m01 | TGTTACCCAGATGCA | lnaTs;omeGs;lnaTs;omeUs;lnaAs;omeCs;lnaCs;omeCs;lnaAs;omeGs;lnaAs;omeUs;lnaGs;omeCs;lnaA-Sup | 10340 |
| SMN1-126 m01 | GTTACCCAGATGCAG | lnaGs;omeUs;lnaTs;omeAs;lnaCs;omeCs;lnaCs;omeAs;lnaGs;omeAs;lnaTs;omeGs;lnaCs;omeAs;lnaG-Sup | 10341 |
| SMN1-127 m01 | TTACCCAGATGCAGT | lnaTs;omeUs;lnaAs;omeCs;lnaCs;omeCs;lnaAs;omeGs;lnaAs;omeUs;lnaGs;omeCs;lnaAs;omeGs;lnaT-Sup | 10342 |
| SMN1-128 m01 | ACCCAGATGCAGTGC | lnaAs;omeCs;lnaCs;omeCs;lnaGs;omeAs;lnaUs;lnaGs;omeCs;lnaAs;omeGs;lnaTs;omeGs;lnaC-Sup | 10344 |

TABLE 4 -continued

Oligonucleotide sequences made for testing human cells obtained from subjects with
Spinal Muscular Atrophy (See Table 3 for structural features of formatted sequence).

| Oligo Name | Base Sequence | Formatted Sequence | SeqID |
|---|---|---|---|
| SMN1-129 m01 | CCCAGATGCA GTGCT | lnaCs;omeCs;lnaCs;omeAs;lnaGs;omeAs;lnaTs;omeGs;lnaCs;omeAs;lnaGs; omeUs;lnaGs;omeCs;lnaT-Sup | 10345 |
| SMN1-130 m01 | CCAGATGCA GTGCTC | lnaCs;omeCs;lnaAs;omeGs;lnaAs;omeUs;lnaGs;omeCs;lnaAs;omeGs;lnaTs; omeGs;lnaCs;omeUs;lnaC-Sup | 10346 |
| SMN1-131 m01 | CAGATGCAGT GCTCT | lnaCs;omeAs;lnaGs;omeAs;lnaTs;omeGs;lnaCs;omeAs;lnaGs;omeUs;lnaGs; omeCs;lnaTs;omeCs;lnaT-Sup | 10347 |
| SMN1-132 m01 | AGATGCAGT GCTCTT | lnaAs;omeGs;lnaAs;omeUs;lnaGs;omeCs;lnaAs;omeGs;lnaTs;omeGs;lnaCs; omeUs;lnaCs;omeUs;lnaT-Sup | 10348 |
| SMN1-133 m01 | TTTTACTCAT AGCTT | lnaTs;omeUs;lnaTs;omeUs;lnaAs;omeCs;lnaTs;omeCs;lnaAs;omeUs;lnaAs; omeGs;lnaCs;omeUs;lnaT-Sup | 10942 |
| SMN1-134 m01 | TTTACTCATA GCTTC | lnaTs;omeUs;lnaTs;omeAs;lnaCs;omeUs;lnaCs;omeAs;lnaTs;omeAs;lnaGs; omeCs;lnaTs;omeUs;lnaC-Sup | 10943 |
| SMN1-135 m01 | TTACTCATAG CTTCA | lnaTs;omeUs;lnaAs;omeCs;lnaTs;omeCs;lnaAs;omeUs;lnaAs;omeGs;lnaCs; omeUs;lnaTs;omeCs;lnaA-Sup | 10944 |
| SMN1-136 m01 | TACTCATAGC TTCAT | lnaTs;omeAs;lnaCs;omeUs;lnaCs;omeAs;lnaTs;omeAs;lnaGs;omeCs;lnaTs; omeUs;lnaCs;omeAs;lnaT-Sup | 10945 |
| SMN1-137 m01 | ACTCATAGCT TCATA | lnaAs;omeCs;lnaTs;omeCs;lnaAs;omeUs;lnaAs;omeGs;lnaCs;omeUs;lnaTs; omeCs;lnaAs;omeUs;lnaA-Sup | 10946 |
| SMN1-138 m01 | CTCATAGCTT CATAG | lnaCs;omeUs;lnaCs;omeAs;lnaTs;omeAs;lnaGs;omeCs;lnaTs;omeUs;lnaCs; omeAs;lnaTs;omeAs;lnaG-Sup | 10947 |
| SMN1-139 m01 | TCATAGCTTC ATAGT | lnaTs;omeCs;lnaAs;omeUs;lnaGs;omeCs;lnaUs;omeUs;lnaCs;omeAs;lnaAs; omeUs;lnaAs;omeGs;lnaT-Sup | 10948 |
| SMN1-140 m01 | ATAGCTTCAT AGTGG | lnaAs;omeUs;lnaAs;omeGs;lnaCs;omeUs;lnaTs;omeCs;lnaAs;omeUs;lnaAs; omeGs;lnaTs;omeGs;lnaG-Sup | 10950 |
| SMN1-141 m01 | TTCATAGTGG AACAG | lnaTs;omeUs;lnaCs;omeAs;lnaAs;omeGs;lnaUs;omeGs;lnaGs;omeAs;lnaAs; omeAs;lnaCs;omeAs;lnaG-Sup | 10955 |
| SMN1-142 m01 | TCATAGTGGA ACAGA | lnaTs;omeCs;lnaAs;omeUs;lnaAs;omeGs;lnaTs;omeGs;lnaGs;omeAs;lnaAs; omeCs;lnaAs;omeGs;lnaA-Sup | 10956 |
| SMN1-143 m01 | CATAGTGGA ACAGAT | lnaCs;omeAs;lnaTs;omeAs;lnaGs;omeUs;lnaGs;omeGs;lnaAs;omeAs;lnaCs; omeAs;lnaGs;omeAs;lnaT-Sup | 10957 |
| SMN1-144 m01 | ATAGTGGAA CAGATA | lnaAs;omeUs;lnaAs;omeGs;lnaTs;omeGs;lnaGs;omeAs;lnaAs;omeCs;lnaAs; omeGs;lnaAs;omeUs;lnaA-Sup | 10958 |
| SMN1-145 m01 | TAGTGGAAC AGATAC | lnaTs;omeAs;lnaGs;omeUs;lnaGs;omeGs;lnaAs;omeAs;lnaCs;omeAs;lnaGs; omeAs;lnaTs;omeAs;lnaC-Sup | 10959 |
| SMN1-146 m01 | AGTGGAACA GATACA | lnaAs;omeGs;lnaTs;omeGs;lnaGs;omeAs;lnaAs;omeCs;lnaAs;omeGs;lnaAs; omeUs;lnaAs;omeCs;lnaA-Sup | 10960 |
| SMN1-147 m01 | GTGGAACAG ATACAT | lnaGs;omeUs;lnaGs;omeGs;lnaAs;omeAs;lnaCs;omeAs;lnaGs;omeAs;lnaTs; omeAs;lnaCs;omeAs;lnaT-Sup | 10961 |
| SMN1-148 m01 | TGGAACAGA TACATA | lnaTs;omeGs;lnaGs;omeAs;lnaAs;omeCs;lnaAs;omeGs;lnaAs;omeUs;lnaAs; omeCs;lnaAs;omeUs;lnaA-Sup | 10962 |
| SMN1-149 m01 | TGTCCAGATT CTCTT | lnaTs;omeGs;lnaTs;omeCs;lnaCs;omeAs;lnaGs;omeAs;lnaTs;omeUs;lnaCs; omeUs;lnaCs;omeUs;lnaT-Sup | 11367 |
| SMN1-150 m01 | GTCCAGATTC TCTTG | lnaGs;omeUs;lnaCs;omeCs;lnaAs;omeGs;lnaAs;omeUs;lnaTs;omeCs;lnaTs; omeCs;lnaTs;omeUs;lnaG-Sup | 11368 |
| SMN1-151 m01 | TCCAGATTCT CTTGA | lnaTs;omeCs;lnaCs;omeAs;lnaGs;omeAs;lnaTs;omeUs;lnaCs;omeUs;lnaCs; omeUs;lnaTs;omeGs;lnaA-Sup | 11369 |
| SMN1-152 m01 | CCAGATTCTC TTGAT | lnaCs;omeCs;lnaAs;omeGs;lnaAs;omeUs;lnaTs;omeCs;lnaUs;omeCs;lnaTs; omeUs;lnaGs;omeAs;lnaT-Sup | 11370 |

TABLE 4 -continued

Oligonucleotide sequences made for testing human cells obtained from subjects with Spinal Muscular Atrophy (See Table 3 for structural features of formatted sequence).

| Oligo Name | Base Sequence | Formatted Sequence | SeqID |
|---|---|---|---|
| SMN1-153 m01 | CAGATTCTCTTGATG | lnaCs;omeAs;lnaGs;omeAs;lnaTs;omeUs;lnaCs;omeUs;lnaCs;omeUs;lnaTs;omeGs;lnaAs;omeUs;lnaG-Sup | 11371 |
| SMN1-154 m01 | AGATTCTCTTGATGA | lnaAs;omeGs;lnaAs;omeUs;lnaTs;lnaCs;omeCs;omeAs;omeUs;lnaGs;omeAs;lnaTs;omeGs;lnaA-Sup | 11372 |
| SMN1-155 m01 | GATTCTCTTGATGAT | lnaGs;omeAs;lnaTs;omeUs;lnaCs;omeUs;lnaCs;omeUs;lnaTs;omeGs;lnaAs;omeUs;lnaGs;omeAs;lnaT-Sup | 11373 |
| SMN1-156 m01 | GGAAGTATGTTAATT | lnaGs;omeGs;lnaAs;omeAs;lnaGs;omeUs;lnaAs;omeUs;lnaGs;omeUs;lnaTs;omeAs;lnaAs;omeUs;lnaT-Sup | 11400 |
| SMN1-157 m01 | GAAGTATGTTAAATTT | lnaGs;omeAs;lnaAs;omeGs;lnaTs;omeAs;lnaTs;omeGs;lnaTs;omeUs;lnaAs;omeAs;lnaTs;omeUs;lnaT-Sup | 11401 |
| SMN1-158 m01 | AAGTATGTTAAATTTC | lnaAs;omeAs;lnaGs;omeUs;lnaAs;omeUs;lnaGs;omeUs;lnaTs;omeAs;lnaAs;omeUs;lnaTs;omeUs;lnaC-Sup | 11402 |
| SMN1-159 m01 | AGTATGTTAATTTCA | lnaAs;omeGs;lnaTs;omeAs;lnaTs;omeGs;lnaTs;omeUs;lnaAs;omeAs;lnaTs;omeUs;lnaTs;omeCs;lnaA-Sup | 11403 |
| SMN1-160 m01 | GTATGTTAATTTCAT | lnaGs;omeUs;lnaAs;omeUs;lnaGs;omeUs;lnaTs;omeAs;lnaAs;omeUs;lnaTs;omeUs;lnaCs;omeAs;lnaT-Sup | 11404 |
| SMN1-161 m01 | TATGTTAATTTCATG | lnaTs;omeAs;lnaTs;omeGs;lnaTs;omeUs;lnaAs;lnaAs;omeUs;lnaTs;omeUs;lnaCs;lnaAs;omeUs;lnaG-Sup | 11405 |
| SMN1-162 m01 | ATGTTAATTTCATGG | lnaAs;omeUs;lnaGs;omeUs;lnaTs;omeAs;lnaAs;omeUs;lnaTs;omeUs;lnaCs;omeAs;lnaTs;omeGs;lnaG-Sup | 11406 |
| SMN1-163 m01 | TGAAATATTCCTTAT | lnaTs;omeGs;lnaAs;omeAs;lnaAs;omeUs;lnaAs;omeUs;lnaTs;omeCs;lnaCs;omeUs;lnaTs;omeAs;lnaT-Sup | 10064 |
| SMN1-164 m01 | TATAGCCAGGTCTAA | lnaTs;omeAs;lnaTs;omeAs;lnaGs;omeCs;lnaCs;omeAs;lnaGs;omeGs;lnaTs;omeCs;lnaTs;omeAs;lnaA-Sup | 10076 |
| SMN1-165 m01 | ATAGCCAGGTCTAAA | lnaAs;omeUs;lnaAs;omeGs;lnaCs;omeCs;lnaAs;omeGs;lnaGs;omeUs;lnaCs;omeUs;lnaAs;omeAs;lnaA-Sup | 10077 |
| SMN1-166 m01 | AGGTCTAAAATTCAA | lnaAs;omeGs;lnaGs;omeUs;lnaCs;omeUs;lnaAs;omeAs;lnaAs;omeAs;lnaTs;omeUs;lnaCs;omeAs;lnaA-Sup | 10083 |
| SMN1-167 m01 | GTCTAAAATTCAATG | lnaGs;omeUs;lnaCs;omeUs;lnaAs;omeAs;lnaAs;omeAs;lnaTs;omeUs;lnaCs;omeAs;lnaAs;omeUs;lnaG-Sup | 10085 |
| SMN1-168 m01 | TCTAAAATTCAATGG | lnaTs;omeCs;lnaTs;omeAs;lnaAs;omeAs;lnaAs;omeUs;lnaTs;omeCs;lnaAs;omeAs;lnaTs;omeGs;lnaG-Sup | 10086 |
| SMN1-169 m01 | TAAAATTCAATGGCC | lnaTs;omeAs;lnaAs;omeAs;lnaAs;omeUs;lnaTs;omeCs;lnaAs;omeAs;lnaTs;omeGs;lnaGs;omeCs;lnaC-Sup | 10088 |
| SMN1-170 m01 | AAAATTCAATGGCCC | lnaAs;omeAs;lnaAs;omeAs;lnaTs;omeUs;lnaCs;omeAs;lnaAs;omeUs;lnaGs;omeGs;lnaCs;omeCs;lnaC-Sup | 10089 |
| unc-232 m12 | CTACGCGTCGACGGT | lnaCs;dTs;lnaAs;dCs;lnaGs;dCs;lnaGs;dTs;lnaCs;dGs;lnaAs;dCs;lnaGs;dGs;lnaT-Sup | 13095 |
| unc-232 m01 | CTACGCGTCGACGGT | lnaCs;omeUs;lnaAs;omeCs;lnaGs;omeCs;lnaGs;omeUs;lnaCs;omeGs;lnaAs;omeCs;lnaGs;omeGs;lnaT-Sup | 13095 |
| unc-293 m12 | CCGATTCGCGCGTAA | lnaCs;dCs;lnaGs;dAs;lnaTs;dTs;lnaCs;dGs;lnaCs;dGs;lnaCs;dGs;lnaTs;dAs;lnaA-Sup | 13096 |
| unc-293 m01 | CCGATTCGCGCGTAA | lnaCs;omeCs;lnaGs;omeAs;lnaTs;omeUs;lnaCs;omeGs;lnaCs;omeGs;lnaCs;omeGs;lnaTs;omeAs;lnaA-Sup | 13096 |

The foregoing written specification is considered to be sufficient to enable one skilled in the art to practice the invention. The present invention is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

Lengthy table referenced here

US10059941-20180828-T00001

Please refer to the end of the specification for access instructions.

Lengthy table referenced here

US10059941-20180828-T00002

Please refer to the end of the specification for access instructions.

Lengthy table referenced here

US10059941-20180828-T00003

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US10059941B2). An electronic copy of the table will also be available from the USPTO upon request and payment of the fee set forth in 37 CFR 1.19(b)(3).

SEQUENCE LISTING (13107 sequences)

SEQ ID NO: 1 - DNA, 52075 bp, Homo sapiens
cctgtaataccagctacttgggaggctgaggcaggagaatcgcttgaacccaggaggtggagatttcagtgagccgagattgcaccactgcactccagtctgggtgacagagcaagacttcatctcaaagaaataaataaataaaaaacaaggccgggcatggtggctcatgcctgtaatccagcactttgggaggctgaggctgaggtgggcagatcacctgaggtcaggagttcaagaccagcctggccaacatggtgaaaccccgtctctactaaaaatacaaaaattagccaagcgtggtggtgggcgcctgtaatcccaactacttgggaggctgaggcaagagaatttcttgactctgggaggcaaaggttgcagtgagccgagactgcaccactgcactctagcctgagcaacagaacaagactctgtctcaaaaaaaaaaaaaaaaaaaaaacatacaaaccgaatttccattccacatactactcttgctgttttaccacttggacaagactgcttgctggtacataagttctggaacacttccttgcagcagtctggctgagccttggtatttaaaagaaatttacctaccagcctggctataattgacataatcctattaaatacttgccttttatgaacatatatcacatgacataagtttttgtcaaatactttttttttggtcaaagactgtagccttataccactcaagggggctgttagggtagcttatgaatggatatttcatacagagttacgtatttaacccatttcctgtttagaaaataaaagtggccaggcgccgtggctcacgcctgtaatcctagcactttgggaggccgaggtgggtggatcacgaggtcaggagatcgagaccgtcctggctaacatggtgaaaccccgtctctactaaaaatacaaaacattagccgggcatggtggcaggcgcctgtagtcccagctactcgggaggctgaggcaggagaaaggcatagacccgagaggcggagcttgcagtgagccgagatcatgccactgcactccatgcactccagcctgggcgacagagtgagactccgtctcaaaaaaaaaaaaagaaaaaaagaaaaaaaaagtgcagctggctgccagcgctcatttaattttacataaacacactctgaggttgacgcaaattaattttcaatgtgaaaatacacaaactgttcttagagttatttctaaacagaacttgtctctaatcctaatataatggaaatgtatataatgttacattaggattagaggcaagagtattcttggggcaaacgggaaatgggttagtatatacttgaagtaatataaccacatctaacctgatttcatgatatattggaatttttggttgcaagcaacaggatcagattaatgaacttactgataaaaatcttatttgaaagaatgagagactccagagtcatggaaaagttgaggactcaaggctttggaaaggtcaagaattgtaacagtttcaggtatcttaagagtaggtgttatgaggtgtttgtttttgtttttttttcttacagtgctgatatcaggttgaacttctgacatgtatatttagtttttatgtcacttggagtgcctccaactgaagttacatgggttaggtacccatccctcagcaagaggagggcaagttgatggtaaaaccaactctagtaaggagtaggtggtcccctgtattagtccgttctcatgctgataataaagacatactcgagactggataatttataaaggaaagaggtttaattgactcacagttgtgtatggctggggaggcctcaggaagcttacaatcatggcagaaggggaagcaaatacatccttcttcacatgatggcaggaaggagaagtgcaaagcaaaaggggaaaagccccttatgaaaccatcagatctcctgagaactcactcactatcatgagaacagcatgaaggtaaccacccccatgattcaattacctcccaccaggtccctcccatgacacatgggaattataggagctacaattcaggatgagatttgggttggggacacagccaaactatatcatcccccaaaaaatttagggttctttgccaaaaggaagggagaatggatgctgagcagactaaaataatatattttaatccctcttattgaaaagctaagactaaatttttaaaattgtatgtttttgtttttttgagacggagtgtcgctctgtcgcccggctggagtgcagtggcgcgatctcagctcactgcaacatccacctcccgaattcaaacaattctcccacctcagcctcctgagtagctgggactacaggagcataccaccatgcccagctaatttttgtatttttagtagagatgaggtttcaccatattggtcaggctggtctcgaactgacctcaggcaatctacccaccttggcctcccaaagtgctgggattacagacatgagccaccacgcccagctaattctgtattttaagtagagacggggtttcaccatgttggtcaggctggtctcgaactcctgacctcaggtgatccgccagccttggcctcccaaagtgctgggattacaggcgtgagccaccgagcctggctgtatttttaaatacaaaaatttgccaggtattgtgatgggtgcctgtaatctcagctactcgggaggcagaggccggagagtcacttgaacccaggaggttgcagtgagctgagatcacaccactgcactgcagcctgggtgacagaatgagactccatctaaaaaaagaaaaaaatgtattttttaaaatacatgatatggcaaatcataaaggtggtaagcatctgaagtgtgagaaataatcatgcagcttatgcagtttttgtctctaccaatctttcaaaccctcaaactgcaatgcttgctcattatagaaaatctgggaaaatacagtaagttctaaatttccataaattctaaatagcatctctttgaaaactaactccttgggcatttatcccagtgaaatgataataaacagccagcatttgaaatgtatatttcaatgactcgtatatgaatactatgttcagatcacaataaaggacatttccagcaccctcttagataatgcctcccatctgattatcaccatagattagttttgcctgtttttgaattttttgtaaatgggatcacacggtatgtgctgtagtgagcctagcttgatttgctcaacgttacgtctaaaagaattctctattttgctgctatgcagcagttcagcctttttcactgttgtgtagcattctgttatatgaatataccataatttagttactctacatttcatggacctttgaattgctcccactttggggctgttatgaataatgctaccgtaacatttttgtatatcttatgatggtcttaaacacgctatctactgagtatatgccaggaatggaattgctgggtcatagggtgtgtgtctatacacacacatacacacattttttagtaggtaccatcaaacaattgcatttttgttgtttttgttttagtttgtttttaatgaccataccattttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtctcattcccctgaactaaccaatgttaataatggtatgcttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccactgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccaggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtgctgggattacaggcgtgagccactgcgcccggcagtctttccttcttttttttttttttttttttttttttaatgacatggggtcttactttattactcaggctggtctcaaacttctggcctcaagggatcttcccaccttggcctcccaaattgctgggattacaggcataagtcatcatgcctggctacaaacagatattttcaataagaggataaaagttcatttccccatactttgctaacatcaaatgttattaattcctaatagttttgccaaactgagaggaaaatggtatgttagtttttctgggttttctttctttttaattttttttcttttttattcatcgcaacactattcacgatttttttattttttattttatttatttatttttttttttttgagacaaggtctccctatgttgcccaggctggtcttgtacccctgggctcaaaggatcctcctgcctcagcctcccaaagtgctaggattacaggcatgagtcaccacgcctggttcacaatttctttttgtttttaccaaaggcaggtatattcctgaaattttttgtttttttgttttttttttgagatgaagtctcaccctgtcactcagactggagtgcactggcacgatctcagctcactgcaacctccgcttcctaggttcaagcgattctcctgcctcagtcttcaaagtagctaggattataggcgccgcaaccatgctcagctaatttttgtatttttagtagagacaggatttcaccatgttggccagggtgatctcaaatcctgacctcaagtgatccgcctgcctcagcctcccaaagtgctgggattactggcatgagccaccgtgccaggccctgaaatgttatcttagttattaatttgcaattccttggctctagaggttgggcatcttctcagatctctagtggacatttggattttctttttggtgaactgtccagtttttctctctgctttacaatctttattatatgcaatcttcacatgtaggtactaccatttttttagtttgtttttgaaacagcatattgctctgttgcccaggctggagcacggtggcaaaaacatggcttactgcagcctttgacctccttggctcaagtactcctcctgtctcagcctcctgagtagctggtaccacaagcccataccaccatgcccagctaatttatttttgtagagatggggcctgaccatgttacttgggctcaaatgatcctctcccactcagcctcccaaagtgctaggattacaggcatgagccaccatacttggcccttttttttttttttttttttttttttttgagacagagtcttgctctgtctcacaggctggtgtgcagtggcacgatctcagctcattgcaacctccacctcccagtttcaagtgatttttgtgcctcagcctccctagtagctgagattacaggcatgcaccaccatgcctggctgactttcatatctttagtgttgccatgttggctaggctggtctcaaactcctgacctcatgtgatccacctgcctcggactcccacagtgctgggattacaggtgttagccaccaccccgacattatttgaaacttttattttatcatgagagagttccaggagtcaactgaagacagatttttggtatgaaaattacatatgcaaaaagactgattccagtacatgaaattaaattcaacatttacattaaatgccttcaaatatggtaaaatggtttcttttggcagtttacctcattatgttttgaatgatttgtctatcatatgaaataacttttataaatatagtaactcaggcctgggcacagcggctcaagtgggaggactgcttaagcaaccgagtttgagaccagcgtggacaacatggggagaccccttctctcccaaaaaatagctgagcatggcagcgcactgttaaaggaaacagagtttctttggtgggtgattaaaatgttctggagttagatagtggtgatggttgcacaaccttgtgaatatattaaggtttccgctcaatctaccattcaattgtactctctaaaatgattaattctatagtatatcaattatatctctaaataataaaaacaaaaagaaatggctgggtgcggtggctcatgcctgtaatcgcagcactttgggaggctgaggcgggcggatcacaaggtcaggagtttgagaccaacctgaccaacatggcaaaaccccgtctctactaaaaatacaaaaattagctgggcgtggtggcacacgcctgtaatcccaggtactcgggaagctgagacaggagaatcacttgaacccgggaggcagaggttgcagtgagccactgcactccagtctgggtggcagagcgagactccgtctcaaaaagaaaaaaattaaaaaacaaaaagaaacctggttctatattttgtttaaatttatttttttaaccatcatgtaatatgtccacgtaatttgtttaaattttgacatcaaatgcaattgtgagaatttttatgattcagaaaaatctaagcaagctttataaaaacatacttttttttttacttttttttttttttctgagacacagcctcactctgtcgcccaggctggagtgcaggttttcatgtttatctgtgagatgtacctttggcacattactttcctgacatgagatttaaaatttttttttttatcttgtgacaatttaacttttttgacacataaaaattgtacatatttatttgtttgagatggagtcgcactctgtcactcaggctggagtgcagtggcgtgatcttggctcactgcaacctccgcctcccgagttcaagagattctcctgcctcagcctcccaagcagctgtcattacaggcctgcaccaccacacccggctgatttttgtatttttaggagaaacagggtttcaccatgttggccaggctggtcttgaactcctgacctcaagtgatccacccaccttggcctcccaaagtgctgggattataggcatgagccaccgtaccagacccctaaaaattgtatatatttaaggtgtaccatttgatgtttagatatacattgtgaaatgattacattccacatattacctctacggagttaccatttttgtacacttggtcaacatcatcccattctccccttcctccacagatatttcttgtatactatatagaagccaagggtattttgggggaagagctcaaagttcctttcgtggagttaaaaatatatatatactatgtacatataagccatttagcaaccctagatgcttaataaagaatactggaggcccggtgtggtggctcacacctgtaatcccagcactttgggaggccgaggcggtcggattacgaggtcaggagttcaagaccagcctggccaacatggtgaaaccccatctttactaaaaatacaaaaattagccgggtgtggtggtgggcgcctgtaatcccagctactcggggggctgaggcaggagaattgcttgaacctgggaggcagaggttgcagtgagctgagatcacgccactgcattccagcctgggtgacagagcaatactctgtcgcaaaaaaaaaaaagaatactggaggctgggcgaggtggctcacacctgtaatcccagcattttgggatgccagaggcgggcggaatatcttgagctcaggagttcgagaccagcctacacaatatgctccaaacgccgcctctacaaaacatacagaaactagccgggtgtggtggcgtgcccctgtggtcctagctacttgggaggttgaggcgggaggatcgcttgagctcgggaggtcgaggctgcaatgagccgagatggtgccactgcactctgacgacagagcgagactccgtctcaaaacaaacaacaaataaggttgggggatcaaatatcttctagtgtttaaggatctgccgccttccttcctgcccccatgtttgtctttccttgtttgtctttatatagatcaagcaggttttaaattcctagtaggagcttacatttacttttccaagggggagggggaataaatatctacacacacacacacacacacacacacacacacacacacactggagttcgagacgaggcctaagcaacatgccgaaaccccgtctctactaaatacaaaaaatagctgagcgtggtggcgcacgcctatagtcctagctactggggaggctgaggtgggaggatcgcttgagcccaagaagtcgaggctgcagtgagccgagatcgcgccgctgcactccagcctgagcgacagggcgaggctctgtctcaaaacaaacaaacaaaaaaaaaaggaaaggaaatataacacagtgaaatgaaaggattgagagaaatgaaaaatatacacgccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccaggtgaggtcgcagccagtgcagtctccctattagcgctctcagcacccttcttccggcccaactctccttccgcagcctcgggacagcatcaagtcgatccgctcactggagttgtggtccgcgtttttctacgtcttttcccactccgttccctgcgaaccacatccgcaagctccttcctcgagcagtttgggctccttgatagcgttgagtggaggccctgccgcgacttggcagtagcttattttgttcactcctctctggctggtgtgggggaggtgggggcattaggccagggtgaagcaggggaaccacttaggagtctgttaagatgatctgaacttcagaacaagatgttattaacagagtgaaagtatttggattctgggtatattttgaaatcggaggcaacaggtttttcagatagattcgataacggaggttatcctgaatagttgaaaagataaagttgccttttgctgaggtgggaaagagaagattgccagtagagcaggtttctcaggagttcagtcttgggcatagcatggtaggggtgaatttggctggagtgagttggagagtaggagaagagaaatccaaggcaacatttgaccagcctgggcaacatagtgtgactccgagtctgcaaaaattagacgggtgttgtggtgcgcgtctgtggtctcagctacctggaaggttcaggccttggaaggctcagggaggtggaggctgcagtgatctgtgattgcgcctctgcactccagcctgggcgacagagccagaccctgtcttaaaacaaaataaacggccgggcgcggtggctcaagcctgtaatcccagcactttgggaggccgaggcggccggatcacaaggtcaggagatcgagaccatcctggctaacacggtgaaaccccgtctctactacaaatacaaaaaattagccgggcgtggtgacgggcgcctgtagtcccagctactcgggaggctgaggcaggagaatgtcatgaagccgggaggcggagcttgcagtgagccgagatcgcgccactgcactccagcctgggcgatagagcaagactccgtctcaaataaataaataaataaataaataaataataaaaacatcggtaggcatatttcaaggaattctatttaaaaaaaatttttttagagacaagttcgctctctgtggcccaggctggagtacagtggcatgatcctagcccatggcagcgttgatctcttggcctcaagcgaccctcctttggagtcgctgggcctaaaggagtgagccaccacgaaattttattataaatggagggtagagaaattgggcaataaatggagggggaagtgagttaagaggaattttaattatgtgtgtgtggttttaaaagaggggggtcttgctctgttgcccaggctgctggggtgccagtggcgcaatcatgaatcactacagccttggactcctggcctcaagctatcctcccacctctgcctcccaaagtactgggattactagtgtgagccactgcactaagataggagcaacatgtttcagcatgtttgtgggttgataggaaagatgagaatgggaaagttgatgtcggaaagaagacaatggctagagcaatgtcctagagtaggtaagaagggatggatttggcctttgttggaaacattagcggttcttttggtgacagctatatagttaacacatctatgatacgtgaatgggcagataggatggcaggagattttgaaagttctcttgattcttactgttctcttagtgaaagaagcaaggttatcagctagaagctgggatgggagaggaaagagaagatgggaagtagatagttctttagaagagtgggcaagggttggactagggaagtttagtggaaatattgctaggcaacataaagagcctacttgagattcgtggtcatgagttgaaggagaccagacagcaagattgtgtatgagggcacccacagagtaaatggagagttgaaattaatgcagttgtgattttaccacgtggatatgaagaagtgagggggagaagtacaaaggagttctcttaatgattgaccatggaatttaagctggctaagaaaggaagtgagaggccgggcgcggtggctcacgcctgtaatcccagcactttgggagactgaggtgggtggattacctgaggtcaggagtttgagaccaacctggccgatatggcgaaaccccatctctaataaaaatacagaaaaattagccgggaatggtggcaggtgcctgtaatcccagctactcaagaggctgtggcaggagtatcccttggacccaggaggtggaggttgcagtgagccgagatcacgccactgtactccagcctggacgatatagtgagacttcacctcaaaaaaaaaaaaaaaagaaaggaagtgaggattttaagaccctgagagacagtttaaaaagtgggaggatcggccgggcgctgtggctgacacctgtaatcccagcactttgggaggccgagttgggcagatcacaaggtcaggagttcgagaccagcctggccaatatggtgaaaccttgtctctactaaaaatacaaaaattagccgggcatggtgtcacgtgtctataatcccagctactcgggaggctgaggcagaaaaattgcttgaacctgggaggcagaggttgcagacagctgagatcactccattgcactccagcctgggcaacaagagcaaaactttgtctttaaaaaaaaaaaaaaaaaaagaatacaaaaattagccgggcgtggtggcgcgtgcctataatcccagctacttgggaggctgaggcaggagaatcagttgaacacgggaggcgaggtttgcagtgagccgagattgcgccactgcactccagcctgggcgacagagcaggactcctcttggaaaaaaaaaattagctgggcatggtggcaggtgcctgtagtctcagctactagggaggctgaggcaggaaaatcacttgaacccgggatgtggagtttgcagtgacccgagatcgtgccactgtactccatcctgggcgacaaaatgagactctgcctcaaaaaaaaaaaaaaaaaaaaaaaaagtgggaggatcaatgtactgccagtcctaatgaagtggaatgattgtccccatcaaatcactagtaggagtaagttgcagagcctagaaggtgatggttaagagagtgggattcttgaaactgcatttatggagaggttgtggttattggttataataaataaatacagttgaagtgagtgagtagctgagatttggggatgtatcagttcattcttacactgctacaaagacatacctgagaccaggtatttataaagataagaggtttaatcagctcacagttctgctgcctgtacaggcttctcttgtggaggcctaaggaaacttacagtcatggtggaaggtgaaggggaaacaagcacagtcttcacatggccagcaggagagagagagaagggggaagtgctacatactttaaaacaaccagatcttgtgagaacgcttatcaggaaacagcacttggggatggtgctaaatcattagaaatcacccccatgatccagtcgcctcctaccatgcccacctccaacactggggatcacaattcagcatgagatttgggtaggaacacagagctgcaccacatcagaggatgtacaagattgtggtggagaggagtttagagacctgcaaatatagggtaattgaagggatcatctacatggatatttaaatcaccaaaaattatgacaggagtagtgttggagagagaactgcgatgtaaacattaaggaatgaggaagagtgactcggtaggctgtaggtgactgcaataggaaacgataatagactgtgagtctggtgacaagattttccttctttctttttttccccccccccgagacagggcctctttttgttgcccaggtgggagtgcagtggcgcgatcacggctcactacaacctcctcccaagctcaagggattctcccacttcagcctctcaagtagctggaactacaggtgctgaccaccatgcctggctactttttgtcaggattttcaaggctgggaattttgagaggggaatggaggagaataatctgaaagtgcaagtaaggagcagggaagatttcttttttcttttttttttttttttttgagtcggagtctggctcagtcgcccaggctggagtgcagtggcgagatctccgctcactgcaagctccgcctcccgtgttcacgccattctcctccttcagcctcccgagtagctgggactacaggcgcccgccaccacgcccagctaattgtttttttgtatttttagtagagacggggtttcaccgtgttagccaggatggtctcaatctcctgactttgtgatccgcccaccccggcctcccaaagcgcttgggattacaggcgtgagccaccgcgccagccagagcagggaagatttcttccccacatctccagtaggtacagtgatatgaagtgtgtggaggagaaaagaggaaacatctatcatttgagatggctgcgaaaggaaaaggcatcctcagggagctagattttacttagagcaagaaatgaagggatgattcagaggttaaaagagtggattttatgaattactcaagggagcacagtggaagtttcaggaagtggtaggagaaggtagaagatggcagggtgttgggaataatttgagaaatctgagctactggaaatgactgagaatcagatataaaggcagtcctggtggtccgttctggctgccgttgctgtgtaacgaatctgccaaaacttagtggcttgaaacaacaaagaacattttattatctctcattgtttctgtgggttaggaatttgtgagagccgtgctgggcagttttcgtgcggctgtctcgtggttgcacctacatagttgctagagctacagtagctggggactgagcagctagggattggcaggctatctctttttttcatgtagtctcatgaagatttctttatgtggtttcaatgtgtgggctggtttggatttccttatagcatggtggcctcagttggattgctgttttgtgatccttttcatccctccttgtcctgtccccagacaaccactgatctactttctgtcaccatagattagcctgcatttttaagaatttttataaacgtggaatgatagagtaccttttttgtcacgtttcttttatttatcatagctattttgattttcatccattttattgctgagtagtatcccattgcatgtatatactatactgtattcattcgcttgcttgtgaacatttgggctttttccagtttgggactgttaacaagtagagccactatgaatattagtgtataagacttcatatagccaaggctggcagatcgcttgagcccaggagtttgagaccagcctgggaaacatggtgaaacctctatttttattttaaaatcaaaaattaaaaattttctataaaaaattttaaagaagactttgtatagacatacgctttcatttttcttgagtgaatacttaggtctcagggtagatgtattttaagtctttaaggagctgtcaaactcttcctcaaagtggtggttgtaccatgttactttttaatataacagagattaattgagcaaagaaaaattcaaaagttggacagcccccacaactaaataggttcagaacagctcccccattttgcattttgaccagcaatgtatgaaagttccatttgctcagtgtccctgcaaacacctggtatggtcagtctttttaattttaggcattataatagatatagtggcttcttgtgattttaattagcatttcctaatgaccagtgctgctgttgatcatttcatgagtgtatttgccatccgtatatcttttttggtgaagtgtctattcaaatcatttgggttttttttttttttgttttttttttttggagacagtgtctcactctgtcacccaggctgttgtgcagtggtgcaatcacacagcctactgcagcctccacctcctgcgctcagtcttcttgtctcagccttctgagtagctgaaattacgagcacacgccacaatgcctggctaattttttaaaattttgtagaaacaaggtctcattatgttgcctgggcttgtcgtgaactcctgggctcaagcaatcttcctgcctcagcctcccaaagattgggattgcaagtatgagccactgcacccggccaacttacccatcttttaattgaatttttttgttgttgaggtttgagagttcttcatgtttgctgggtacaatatctttatcagataggtaacttgcatgtattttctcccggtttacactttggtttttcattttgttaacaacgtctttttaagaacagaaaatcttaattttgctgaaatctaatttttcagttttttctttgatggttttgagagaggaggtaaaaaaagactaggtaagccgatagttagacagagtcctcggtagaacttcccttctaacaaaaagcagcccaagaaatcacttctcttctaacaaggagcagcctggaagatcgggctgtaaacatgtataaggaagcagctctggcacagagggggagcttcctgggtaatcagcaagcttcacatacgtaaggtgggtatgtgaagtaaacacagtatgtgaagtaaacacagtggaccttagtacatactcagataaggaagctggaagcttgcatgttgtgagttgttggggttgcctgcagctgcacggagagaaaggggtacctggggccaggcatgtccaccatggtggctccacctccccttatttagcacatgcacaataggaaagagataagcaatgtggagtagctcaggccaaggacctgcctgcataataaaaggttggggtgggggatgccagagattcacgctctgtgcagatggcaacacctggtcctaactggttttttgctccctatgtgtagataagctacccccttcccattagctcatttataaaaatgcttgcatttcactgtggaatgggaactcttttcaggacctctctctgcaggagagagctagtctctttcttttgcctattaaacttctgctctagcctcacacccttggtgtgtcagcgtccttgatttcctcagcgtgagaccaagaacctcgggtgccaccccaggcaacaaggccatttcagtttgttcttttgttataggcaatccatgatcacagatttttctctcttttttttttttacacagtttagagttttagttttacacttaggtctgtaatccattttgtattaattcttatatgtggctcagtgtaggtggaaatttggtttgtttttgcataaggatttccaatagttttaccaccatttcttgaaactactatgctttctctattaaaccacatttgtaactttagttaaaatcagtcacatatatcacagggctatttctgactctcaattctgttacattgtctattagtgtatattgatgtcagtactacacttttaattactattgcttcagggtatgtcttgtaaaccaaaaataaaattataggccccccccgcccctgcacaaccaactgaatggacccatcctctcagccaagggcattccaaaattaacctgaaaaactagttcaagccatgatgggaagggggagttggacatgtctcatcacaccctactaccttttggaattactgatagaacagactcttaaagtctgaaaagaaacatttacaacctaccctctctgaagcctgctacctgggagcttcatctgcatgataaaaccttggtctccacaaccccttatggtaacccaaacattcctttctgttgataataactctttcaactagttgccaattagaaaatctttaaatcttcctatgacctagaaacctccctacccccactttgagttgtcctgcctttcctgacagaactcatgtacatcttacatatattgattgatgcctcatgtctccctaaaatgtataaaacaaagctgtaccccaccaccttggggacatgtcatcaggacctcctgtggctgtgtcataggagcgtctttaactttggcaaaataaactttctaaattgattgaaacctgtcttagctacttctggtttacagtcttaaagttagataatgtaaattgtccagctttggtttatttttgtccttagtagttccatataaattttagaatcagcttttcaatttaatacactactttcctcttagatccacaattaaatatatttgatgctaacaattctgttttatgtttttcgttttttttttttgagacaagagtttcgctcttgttgcccaggctggagtgcagtggcgcgatcttggctcaccacaacctccacctcccaggttcaagcaattcttctgcctcagcctcccgagtagctgggattacaggcatgcgccaccacgcccggctaattttgtatttttagtagagacggggtttcaccatgttgatcaggctggtcttgaactcctgacctcaggtgatccacccacctcggcctcccaaagtgttgggattacaggcgtgaaccaccatgcctggccagttctgttatttttaaaacccaagtttccctggtcatatcttggttggatgaagcgtattttcaatagattaccctggaaaggctagtgagtacggtattcttctacattttagacttttcttagtcttgctacttcaaggacagctaggctgcatataaaattcttggctcatactttttccccataaatttctatgagaaagtctaatgataactgattttctttattttgtaacttagtctttttgcttagaggctctctgaggatgggagggggttcttcctcccatccctaggaatttttcttttttttaaattcctaatcactagaccaccaggaagattgtttgttttgttttgtttttattcttcagggaccccatttatacatacgttaaataaatactgtttgccaatgtatcaaccattttgcttcttatttatttttgttcctttggttctttttcatggctttgctttggtgctccttagattttcagtcagatgtatttgtccttgggtaccttgtaatcagtattaccttttcttctgtcgctttgttttctgttcgttttgaaattacttgtttcctggtctggcaataacagttgagatatgaggagtttgagctgccatctgtctatgtatcttgctttaagactgcactcttctattgatatcactggccttgattttgtgatttctttatttcttcaggaccacccttcattttctactgtttgcttcctttttttttgagatggagtctcactctgtcactcaggctggagtgcagtgatcttggctcattgcaacctctgcctcccgggttccagcaattctcctgcctcagcctcccaagtatctgggactacaggtgtgcaccaccatgcccggctaagttttgtatttttaatagagacggggttttgccacattggcaggctggtctcaaactcctgatgtcaagtgatccacccaccccacccacctctgcatcccaaagtgctgggattacaggaatgagctgccgtgcccagcctcccccctacccccctttttttctttcgagacagagattataggtgtgagccactggacccagcctgtttttattccttttaccaaatctccaaggaatatcttcccttccaagtgcgaatgtaaccttaagtcagttaacctctttgtgattacttttcttatctgcaaagtgacttaatgatcttaagtactttttttttttgagacagggtctcactgtcaccctggctggagtgcagtggcacgatctctgatctccactcactgcaatctcctcttccctggttcaagcggccctcccaccttagccttctgggtagctgggactacagatgtgaaccaccacgcccagctaatttttgtactttttgtagagatggggttttgccatgttgcccaggctgggattattaagtactttttatcatacagcaagattgacattttatattggaatacatttgtctctatataacggagattaacaggaaaatgacaagcctgggtgcggtggctcatgcctgtaatcccagcactttgggaggctgaggtgggaggatcacttgaggtcaggagttcgagaccagttttgccaagatgatgaaagcccatgtctactaaaaatacaaaaattagcccagcttgatggtgggcgcctataatcccagctatttgagagactgaggcaggagaatcacttgaacctgggcggcagaggttgcagtgagccgagatcatgccactgcactccagcctgggtggcatagcgagactcttgtctcaagagaaaacaaaacaaaacaaaaaaaaaacaggaaaatgacaaaaagtaatattacaactcagtgaattttataacaaacttttttggaattcattgactaatactataccaaatccaaaatactctctagtataccaaatccaactctaccctatagtataaattggattctatttggacttgtctcactaatccctcatacagtgtgttttattttttattgaagtaaaaaaatttgtcattttaaccatttttaagtatatagttcagtaatattaagtatgttcatgttgttgcgcaatagatcttcggaagtttttcgtcttgcaacctgaaactctacccattagcaaattcccatttctccttacacttagcccttggtaatcatcattcttttttttttttttttgagatggagttttactcttgttgcccaggctggagtgcaatggtgcaatctcgactcaccacaacctccgcctcccaggttcaagcaattctacctcagcctcccgagtagctgggattacagtcatgcaccaccacgcccggctaattttgtatttttagtagagaaggggtttctccatgttgaggctggtctcgaactcctgacctcaggtgatctgcccacctcggcctcccaaagtgctgggattacaggcgtgagccactgcgcctggcccattctttctaattctataaatttgactacttagttaccttacataaataaattcttatagttagtgttatttttgcttccatgccttttttgttgttgttcatgctcttacttggaatgcgttctattttgtctacctatgcacatcctgttgggttttttttttttttgggggttttttttgtttttttttgtttttttttcccagacaaggtctcaatttgttacccaggctggagtgcagcggcgccatctccactcactgcatcctcaacttcctgggcccaggtgatcctctcgcctcagcccctgcaggtagctgggactataggcatgtgccaccatgcccagctaaatttggtttttttgtttgtttgtttttgagacagagtctcactctgtcacccaggctggagtgcagtggcacaatctcagctcactgcaatctctgccgcccgggttcaagtgattctcctgcctcagcctcccaagcagctgggattacaggtgactgccaccacgccagctaagttttgtagttttagtagagatggggtttcaccttgttggccatgctggtctcgaactcctgacctcgtgatctgcctgcttctgcctcccaaagtgctggaattacaggcatgagccaccacgcccggccagaatttttgtatttttagtagacacaaggttcttaccctgttgcctaggctggtctggaagtcctggactcaagcaattcacctgccttggcctcccaaaatgctgggattacaagccaccatgcccggcctaaatcctgttgttttgttttgttttattttgttttgttttgttttgtttgttttttgagacagagtctcgctatgtctctcaggctgtagtgcagtggcgcgatcttggctcactgccacctctgcctcccaggttcaagtgattctcctgcctcagcctcccaagtagctgggattacaggcatgtgctactatgtccggctaatttttgtatttttagtagagacagggtttcaccatgttggccaggctggtctcgaactcctgacctcgtgatccacccacctcggccacccaaagtgctgggattacaggcgtgagtggtttttatttcttaggccggtttcctccatatgatcttgcagtagacattaatttctttcctttttaattaaaatactgtttgtatttcacattttgatgtttgttaagatttgttttatattgttttttgttttgtcttgtgtgatagtcttaaatccctagttagataataactggagagtaccatgtttctatatatctctcagtgacttgcacagtgctagcagatagtgctaaaaaattatttattattattattattttgttattgttgttgttgttgttagacagggtcttcctctgtcacccaggctagagggcaatgggatgatcatagcttactgcagcctccaacaactgggctcatgtaattctcctgcctcagcttcccaagtagctgggattacaggcatgagccaccatgtctggacaaaaatatttccaggtgcagtggctcatgcctgtaattcccacacttgggaggccgagcgaggctggaggatcacttgagcctaggagttcaagaccagcttggctaagatggcgagaccccgtccctacaaaaaattttaaaaactagccaggcatggtggcatgcacctatattcccaactactcagtgggctgaggtgggagggtcatttgaacacaggaatttgaggggagaaaaaaagaagagagaaagagaagtgaaggaaggaagaaaggaaggagggagggagagaagaaagaaacgaaagaaaggaaaagaaaaggaaggaaagaaaattggtaccaggaaagcaggaaagggaaatggaagtaaaaaaataataataataataaaatgaaaattggttagtcactattaacaatttgtatccttataatctggaaacattataatttcaaaagaaaaaatattctttggatcataggttctgaggtcagaacagcattcccgtagtctagatgaagtcaagttttatctgatcttaattgaaataaatatagctggccttgaacaaatctactcatggtatgtggataggaattaaattgtaggggcattcacttgatggcattcattcttagaacatttacctatgtctagcttttggagtaaagtcacataacctctaaccaggtaagtttcctgtggctttatttaggattttaaatactcattttcagtgtaattttgttatgtgtggattaagatgactcttggtactaacatacattttctgattaaacctatctgaacatgagttgtttttatttcttaccctttccagagcgatgattctgacatttgggatgatacagcactgataaaagcatatgataaagctgtggcttcatttaaggtatgaaatgcttgcttagtcgttttcttattttctcgttattcatttggaaaggaattgataacatacgataaagtgttaaagtacatgttattcagttttcattttgaagattagatggtagtatgagttagttaaatcaggtgatatcctcctttagaagttgatagcctatatatgtcatcctttgtggaggcaatttaaataaaatttaaaacatttattcctggctgggtatggtggctcactcctgtaatcccagcactttgagaggctgaggcgggtggatcacctgaggtcaggagtttgagaccagcctggccaacatggtgaaaccccgtctttactaaaaatacaaaaattagccaagcatggtggcacgtgcctgtaatcccagctgcttgggacactgaggcaggagaattgcttgaacctggggggcagaggttgcaatgattgcaccactgcactccagcctgggcgatagagtgagactccatctcagaaaacgaacaaacaatgtattccttttagtatttttacattgtatcaaactatggaagtcctctaattgagattaataagaaaaagacaatctgaattataattttaaacatttaacaagcatgtagtaaaataatgatgaagataaatagcattagtacagcaattaatatttgtagcatgctgacagtgctctgtgtgcgtttcatatattaaattactctaatcatcccaaatcctgtaagttgggtatcaattcaagtgttcctattgggtaggaatatacagttcttttaggaaatgtagtatggttctgtgtctcaaacaggacacttacacagttggccaacatcatcaccttctccattctctgagatgtttagtcttactgagcactaaatatgggtcatcaatagtccagactaccttgagcaaacaatagtccagactaccttgagcaaacagagcatatactcatacagtgtataaagagcaccaagcatacagatttcatgtctttctcatagttactcttgtaacatgagctaaagatcagacctctatgtcacctttgtaactgatttctagatttttttttttttttgagatggggtcttgccctgtcacccaggctggagtgtagtggcgtgatcatgcctcattggagccttcaactcatgagctcaaacaatcctcctacctcagcttcctgagtagttgggaccacaggtgtgtgccaccacacccagctcatttttgtattctttgtagagatgcagtctcaccctgttgcccacgctggcctggaactcctgagctcaaaagatccctccgccttgaccttccaaagtgctgggattacaagcatgaaccactgcacccggcctagatttttaaatgtgctttccagtatacactgaaactagaagtcgactaaagaattaccaagagaattctataaaatagagattgaaatggggctcgatgtgggatgggttggtgatattgcagggagaagtaatctgagtaaaggaggaaaagaactgatttgggaaaacgatagttttagtagtgagtttgagtatgaattaagttgagattgaatttgaattaagttgaggttgaatatgaattaagttgaggttgagtttgaggtatgaattaagatgtgaaattgatcattggaaatgttagattgagaaaagtcacagctggattaatagcttcagaagtgtgtttgcagacagttgcaactaaagtaataagaatagatggccttggccgggcgcggtggctcacgcctgtaatcccagtactttgggaggctgaggcgagcaaatcacgaggtcaggagttcaagaccagcctggcccacatggtgaaaccccgtctttattaaaaatacaaaaattagctgtgcacagtggtgcacgcctgtaatcccagctactcgggaggctgagacaggagaatcgcttgaacctgggaggtggaggttgcagtgagctgagatcagtgtgactgcactccagcccggtgacagagtgagactctgtgtaaaaaaataaaataaataaaataatggccgtaagcaagtaaagaaggatggccagctcttattgggaatgcctaaatctaaggcttgatcagaagtaatgaaaccgttggggccctacattgctatgacatccaaagggccatgaatatcaggaagaaagataattaacagggtctaatgttacagagaggttgagagcaaggagatttgattaaaagggtctttagagctgatgtcaggtgtatgatgcctttaagagcagtttttatagtgcagggggtggtcaaaagagaaaataggtgctttctgaggtgacggagccttgagactagcttatagtagtaactgggttatgtcgtgacttttattctgtgcaccaccctgtaacatgtacatttttattcctattttcgtagcatgctctaaagaatggtgacatttgtgaaacttcgggtaaaccaaaaaccacacctaaaagaaaacctgctaagaagaataaaagccaaaagaagaatactgcagcttccttacaacaggttattttaaaatgttgagatttaacttcaaaggatgtctcattagtccttatttaatagtgtaaaatgtctttaacttaagtgattagtacagtgtttctattgacatatacttatacaacttcaaaaacaactattaaattttctgttatttaggaacatgcatattagtcatgaaagtataaagaattagatgggaatgataaatgctaaaatcaggacatgtgttccatttgtgaatggaaggcagggagaaggtgccgtttggaaggagtacccaagagccgtaagctgaattggcagtgttttacatcttaagctgagagatagatttttttttcccctttttctttaaaaactctaaaactgttaattccaaggaacccagaagtctaggtagattatttctgctagttaaaagcagtagtcctgaaagctgaatattttggtgtcttttgagccaactttagtttcatcattaccaagggggaagagagctaacagttgatgagcacttgctctaggccagtccagagtgctgggcaccatacgcattttatctccctcccgctattcacaacaaatatgggaggtagtttatattatagccatctaataagatggggaaactaagactcaaagagattcagaaacttgtccatgattataaatgtaagagagttggaattcagatttatgtatttagaccccaagcctttctcattacatcattttgccttccaaatctctaccctctatccttcacctccccactgatcaaaacgagatgatagtttgccctcttcaaaagaaatgtgtgcatgtatatatctttgatttcttttgtagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagaggtaaggatacaaaaaaaaaaaaattcaatttctggaagcagagactagatgagaaactgttaaacagtatacacagttgtcagtttgatccaccgaggcattaattttttcttaatcacacccttataacaaaaacctgcatattttttctttttaaagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaaggtaaaccttctatgaaagttttccagaaaatagttaatgtcgggacatttaacctctctgttaactaatttgtagctctcccatgaaacttttgtagcttaaatacacaagaattttttgaaaaggaaataagataatgatgcaaaatagttaattttttaaaaaaatgttagacactgcagtggatgcaacaaaatactttatatgaaagatttatccagttaacttttgtggagtattaggtattagactaataattagcacacttacttaagttagaaagtataataatgcgccggacgcggtagctcacgcctgtaatcccagcactttgggaggccaaggtgggcggatcacaaggtcaggagatcgagaccatcctggctaacacggtgaaaccccatctctactgaaaatacaaaaaaatttgccgggcgtgatggcgggcacctgtagtcccagctactcgggaggctgaggcaggaggatggtgtgaaccccggaggcagagcttgcagtgagtcaagatcgtgccactgcactccaacctgggcgacagaatgagactccatctcaaacaaaaaaacaaaacaaaacaaaaaaaagtgtaataataatttatcattagctggatgatatgctgttgtttcccatgtcacctgtataagatatgtaaaataagaacacattatttacatctaatatagataaaatcctgaggcgctctcagattgttttgtagagttcaaatgtaaatattgttttcatttatggtccttttggttataagtaacagaaatcaactctaaaaagatttttattataggttagattatgtcatggaaccttaaggcttgtccctttctagttcttttgtgtaaagcggtgatttcttccatggagggaatggtatttaggcaattttttttttttttcgagatggagtcttgctctgtcgctcaggctggagtgcagtggcaccatttcagctcactgcaacttccacctcctgggttcaagtgattctcctgcttcagcctcccaagtagctgagattacaggcacccgccaccacacccggcttattttgtatttttagtagagatggggtttcaccatgttggccaggctggtcttgaactcctgacctcaagtgatctccccaccttggccttccaaagtgctaggattacaggcgcctagcctaggcagtcattttcaaaaaacaagcatgactcaccaaaagttttaagattttctgtgataatgttcttattgaggcttacattatattacagtttcttgaatctaaaatgatgtaccctcttaggatatatacatcatgcttcattggtctcagggggctgatttttataaggagagatttgctagttttcacaatatgtcctctaagttggcatgtatagctaaacaggctttcataaaaatatacaatttagttaatgaaatttgggatatagtcttttatgattgaaataattttgctaaatagactgtctctgatttattaggtaatcaccactcttattttgttttacttccttaatgtctacatagaaaggaaatgagaaaaatccagaggttgtcatttgacttatgagtctgtttgacttcaggatttggtacatgaaatttcacttaatctttttgatatgtataaaacaaatattctgggtaattatttttatccttttggttttgagtcctttttattcctatcatattgaaattggtaagttaattttcctttgaaatattccttatagccaggtctaaaattcaatggcccaccaccgccaccgccaccaccaccaccccacttactatcatgctggctgcctccatttccttctggaccaccagtaagtaaaaaagagtataggttagattttgctttcacatacaatttgataattagcagaatagaggattgtaaaatgtcattgtagaacatcccttgggccagattctaatgggtagaaatttgaactaaacctctgggttttgtttgtttttaatgcctttctgttacccagatgcagtgctcttgtagtcccaagtctaagctctaggttgccttctttcctggcagaagttggtgtctatgccataaggaggtagttcctgttagaagggatttaattataccttatataaggaattagtgtttgcccttctaggtatagttggatgttagcttctgatgtaaactggatttctttttctttctctctctttttttttttttgttttggaggcagagttttgcccttgtaccccaggctggagtgcagtggtgtgatctcagctcacagcaacctccgcctcctgggttcaagcaattctgcctcggcctcccaagtagctgggattacaggcgactgccaccacacccggctaatttttgttttattagtagagatggggtttcaccatgttggccagactgatcttgaactcctgacctcaggtgatccacccgccttggcctcccaaagcgctgggattacaggcgtgagctgccgcacccagctgtaaactggatttctaatggtagatttttaggtattaacaatagataaaaagatactttttggcatactgtgtattgggatggggttagaacaggtgttctacccaagacatttacttaaaatcgccctcgaaatgctatgtgagctgtgtgtgtgtgtgtgtgtgtgtgtgtgtattaaggaaaagcatgaaagtatttatgcttgattttttttttttactcatagcttcatagtggaacagatacatagtctaaatcaaaatgtttaaactttttatgtcacttgctgtcttttcgtcctcgttaaatttaattttgttggtcttttgttgttattggttggttttctccaaatgctagctatgttaagaaatttaaggccaggtacagtggctcatgcctgtaatcccggcattttagaaggctgaggcaggaggatcacttgagctcaggagtttgagaccagtctgggcaacatagcaagacctcgtctttgtttaggggaaaaaaaagaaatttaagtaggagattatataagcaaaaatacaattaatttccagcattcactatataatataaatctccagactttacttttttgtttactggatataaacaatatctttttctgtctccagataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattactaaaaaataaaaataaaaaaatacaactgtctgaggcttaaattactcttgcattgtccctaagtataattttagttaattttaaaaagctttcatgctattgttagattattttgattatacacttttgaattgaaattatactttttctaaataatgttttaatctctgatttgaaattgattgtagggaatggaaaagatgggataatttttcataaatgaaaaatgaaattcttttttttttttttttttttttgagacggagtcttgctctgttgcccaggctggagtgcaatggcgtgatcttggctcacagcaagctctgccttctggattcacgccattctcctgcctcagcctcagaggtagctgggactacaggtgcctgccaccacgcctgtctaattttttgtatttttttgtaaagacagggtttcactgtgttagccaggatggtctcaatctcctgaccccgtgatccacccgcctcggccttccaagagaaatgaaatttttttaatgcacaaagatctggggtaatgtgtaccacattgaaccttggggagtatggcttcaaacttgtcactttatacgttagtctcctacggacatgttctattgtattttagtcagaacatttaaaattattttattttattttattttttttttttttttgagacggagtctcgctctgtcacccaggctggagtacagtggcgcagtctcggctcactgcaagctccgcctcccgggttcacgccattctcctgcctcagcctctccgagtagctgggactacaggcgcccgccaccacgcccggctaatttttttttatttttagtagagacggggtttcaccgtggtctcaatctcctgacctcgtgatccacccgcctcggcctcccaaagtgctgggattacaagcgtgagccaccgcgcccggcctaaaattatttttaaaagtaagctcttgtgccctgctaaaattatgatgtgatattgtaggcacttgtatttttagtaaattaatatagaagaaacaactgacttaaaggtgtatgtttttaaatgtatcatctgtgtgtgcccccattaatattcttatttaaaagttaaggccagacatggtggcttacaactgtaatcccaacagtttgtgaggccgaggcaggcagatcacttgaggtcaggagtttgagaccagcctggccaacatgatgaaaccttgtctctactaaaaataccaaaaaaaatttagccaggcatggtggcacatgcctgtaatccgagctacttgggaggctgtggcaggaaaattgctttaatctgggaggcagaggttgcagtgagttgagattgtgccactgcactccacccttggtgacagagtgagattccatctcaaaaaaagaaaaaggcctggcacggtggctcacacctataatcccagtactttgggaggtagaggcaggtggatcacttgaggttaggagttcaggaccagcctggccaacatggtgactactccatttctactaaatacacaaaacttagcccagtggcgggcagttgtaatcccagctacttgagaggttgaggcaggagaatcacttgaacctgggaggcagaggttgcagtgagccgagatcacaccgctgcactctagcctggccaacagagtgagaatttgcggagggaaaaaaaagtcacgcttcagttgttgtagtataaccttggtatattgtatgtatcatgaattcctcattttaatgaccaaaaagtaataaatcaacagcttgtaatttgttttgagatcagttatctgactgtaacactgtaggcttttgtgttttttaaattatgaaatatttgaaaaaaatacataatgtatatataaagtattggtataatttatgttctaaataactttcttgagaaataattcacatggtgtgcagtttacctttgaaagtatacaagttggctgggcacaatggctcacgcctgtaatcccagcactttgggaggccaaggcaggtggatcacgaggtcaggagatcgagaccatcctggctaacatggtgaaaccccgtctctactaaaagtacaaaaacaaattagccgggcatgttggcgggcaccttttgtcccagctgctcgggaggctgaggcaggagagtggcgtgaacccaggaggtggagcttgcagtgagccgagattgtgccagtgcactccagcctgggcgacagagcgagactctgtctcaaaaaataaaataaaaaagaaagtatacaagtcagtggttttggttttcagttatgcaaccatcactacaatttaagaacattttcatcaccccaaaaagaaaccctgttaccttcattttccccagccctaggcagtcagtacactttctgtctctatgaatttgtctattttagatattatatataaacggaattatacgatatgtggtcttttgtgtctggcttctttcacttagcatgctattttcaagattcatccatgctgtagaatgcaccagtactgcattccttcttattgctgaatattctgttgtttggttatatcacattttatccattcatcagttcatggacatttaggttgtttttatttttgggctataatgaataatgttgctatgaacattcgtttgtgttctttttgtttttttggttttttgggttttttttgttttgtttttgtttttgagacagtcttgctctgtctcctaagctggagtgcagtggcatgatcttggcttactgcaagctctgcctcccgggttcacaccattctcctgcctcagcccgacaagtagctgggactacaggcgtgtgccaccatgcacggctaattttttgtatttttagtagagatggggtttcaccgtgttagccaggatggtctcgatctcctgacctcgtgatctgcctgcctaggcctcccaaagtgctgggattacaggcgtgagccactgcacctggccttaagtgtttttaatacgtcattgccttaagctaacaattcttaacctttgttctactgaagccacgtggttgagataggctctgagtctagcttttaacctctatctttttgtcttagaaatctaagcagaatgcaaatgactaagaataatgttgttgaaataacataaaataggttataactttgatactcattagtaacaaatctttcaatacatcttacggtctgttaggtgtagattagtaatgaagtgggaagccactgcaagctagtatacatgtagggaaagatagaaagcattgaagccagaagagagacagaggacatttgggctagatctgacaagaaaaacaaatgttttagtattaatttttgactttaaattttttttttatttagtgaatactggtgtttaatggtctcattttaataagtatgacacaggtagtttaaggtcatatattttatttgatgaaaataaggtataggccgggcacggtggctcacacctgtaatcccagcactttgggaggccgaggcaggcggatcacctgaggtcgggagttagagactagcctcaacatggagaaaccccgtctctactaaaaaaaatacaaaattaggcgggcgtggtggtgcatgcctgtaatcccagctactcaggaggctgaggcaggagaattgcttgaacctgggaggtggaggttgcggtgagccgagatcacctcattgcactccagcctgggcaataagagcaaaactccatctcaaaaaaaaaaaaataaggtataagcgggctcaggaacatcattggacatactgaaagaagaaaaatcagctgggcgcagtggctcacgccggtaatcccaacactttgggaggccaaggcgggtgaatcacctgaagtcgggagttccagatcagcctgaccaacatggagaaaccctgtctctactaaaaatacaaaactagccgggcatggtggcgcatgcctgtaatcccagctacttgggaggctgaggcaggagagttgcttgaactgagaaggcggaggttgcggtgagccaagattgcaccattgcactccagcctgggcaacaagagcgaaactccgtctcaaaaaaaaaaggaagaaaaatatttttttaaattaattagtttatttattttttaagatggagttttgccctgtcgcccaggctggggtgcaatggtgcaatctcggctcactgcaacctccgcctcctgggttcaagtgattctcctgcctcagcttcccgagtagctgtgattacagccatatgccaccacgcccagccagttttgtgttttgttttgttttttgttttttttttttgagagggtgtcttgctctgtcccccaagctggagtgcagcggcgcgatcttggctcactgcaagctctgcctcccaggttcacaccattctcttgcctcagcctcccgagtagctgggactacaggtgcccgccaccacacccggctaatttttttgtgtttttagtagagatggggtttcactgtgttagccaggatggtctcgatctcctgaccttttgatccacccgcctcagcctccccaagtgctgggattataggcgtgagccactgtgcccggcctagtcttgtatttttagtagagtcggggtttctccatgttggtcaggctgttctccaaatccgacctcaggtgatccgcccgccttggcctccaaaagtgcaaggcattacaggcatgagccactgtgaccggcaatgtttttaaattttttaaatttaaattttattttttagagaccaggtctcactctattgctcaggctggagtgcaagggcacattcacagctcactgcagccttgacctccagggctcaagcagtcctctcacctcagtttcccgagtagctgggactacagtgataatgccactgcacctggctaatttttatttttatttatttatttttttttgagacagagtcttgctctgtcacccaggctggagtgcagtggtgtaaatctcagctcactgcagcctccgcctcctgggttcaagtgattctcctgcctcagcctcccaagtagctgggattagaggtccccaccaccatgcctggctaattttttgtactttcagtagaaatggggttttgccatgttggccaggctgttctcgaactcctgagctcaggtgatccaactgtctcggcctcccaaagtgctgggattacaggcgtgagccactgtgcctagcctgagccaccacgccggcctaatttttaaattttttgtagagacagggtctcattatgttgcccagggtggtgtcaagctccaggtctcaagtgatccccctacctccgcctcccaaagttgtgggattgtaggcatgagccactgcaagaaaaccttaactgcagcctaataattgttttctttgggataacttttaaagtacattaaaagactatcaacttaatttctgatcatattttgttgaataaaataagtaaaatgtcttgtgaaacaaaatgctttttaacatccatataaagctatctatatatagctatctatgtctatatagctattttttttaacttcctttattttccttacagggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattagctgtatctgtgattgtatttcttttttgcatattattttgccctttggcccatattttgatatggatgccaccatagcattttgtgtatgtgcatgtgtattcccacttaatgtcacatttttcatgtctttacatattcttatttttgtttgtttttgagacagagtctcgctctgctgcccacgctggagtgcagtggtgcaatctcagctcactgcaacctgtgctatccgggttcaagcggttctcgtgcctcagccacgtgagtagttgggattacaggcatgtggcaccatgccccactaagttttgtatttttagtagagatggagtttcaccatgttggccaggctggtctcaaactcctgccctcaagtgattcgaccaccctggcctcccaaagtgctgggattacagccgtgagccaccgcacacggcctctctatttatttctatacatagcttttcacattatattatgtttatatattgtttatatctgtatttcctctttcattagagaaaaggtagtacatcttattcttcatggtgtctacaatatctggcagtttttggaagtcaagcgtgagcttagagcatagactggtgggattgtcaaagaagagggcaactggaagagaactgtcagttatttttggatcagtctttaattcatcatgacgggttaggcattagttgtatttcttgctaattttgaagaagacttattaacaaatcctacattaggtaaatggttttgaaagttgagttaatcataatggtgtttgacctaggactatttttaggccctatttatcttaatatcgaataatgaagcagcttcccccttagatatagacagaaaacatcaaagccaccacactacctggctggatttatcctagtaataaaatcaaaactgagctagttctctggctttcattgtaataattgtccttgtggttgtaaggaatctagatgaaaattacatggtctgttctacagccacagctgtacctacattcagaagacagacaaaagttgctgtgtttgaagagatccttcattaagggatcagacagagattactttgagacatattctaagtttaacttttctgcagggttgccattaacagaaataaactacagagttaatttctttttgtttttgatacagtctaactctcacccaagctggagtgcagtggcgcaatttcagctcactgcaacctctgcctcccaggttcaagcaattctcctgcctcagcctcccgagcagctgggactacaggcatgtgccactatgcctggctaatttttgtatttttagtagtagagacgtggtttcgccacgttggccaggctggtctggaactcctgaccccaggtaatccacctgcctcggcctcccaaagtgctgggattacaagcttgagccactacgcctgacccagagttaactttttaaaaaagtttttatgaacttaagtcttgtgatgtttgaaataatggattcaatttagacatcaaattccagaagttactaagagcagctgggcgcggcagctcacacctgtaatcccagcactttgggaggccgaggcgggtggatcacctgagatcaggagttccagaccagcctggccaacatagtaaaaccctgtctctactaaaaatacaaaaattagcccggcatggtggcacgcgcctgtagtcccagctacttgggaggctgaggcaggagaattgcttgaacccgggaggtggaggttgtggtgagccgagattgtgccactgtactcaagcctgggctaaaaagcgagactccgtctcaaaaaaaaaaaaaaaaaaaaaaaaaaaaaaaaaaaaaaaaaaaaaaaaaacaaaacacgttactaagagcaactctgggccaggcacggtggcttacacctgtaatcccagcattttgggaggacgagacaggcggatcacttgagcccaggagttcaagaccagcataagcaacaacgcaaaacccctgactctacaaaaaatgaaagaattagcaaggcatggtggtgcatgcctgtagtcccagctactggagaggctgaggcaaaaggatcacttgagtacaggaggttgaggctgtataatgagccatgttcacaccattgcacttcagcctgggcaacagactgagaccctgtctcaaaaaaaaaaaccaaaccaaagcaacaaacaaaaaacaagagcaactctgcttctgtacacttttttttttttttggtagtgacatgatctatgttgcccaagctggtctcgagttcctgggttcaagccattctcccacctcgggctcccaaagtgctaggattacaggcatgaatcaccatgcccagcccttctgtacacttttcacagtgtacccttttgtgttttttaaaatgtttgtgtatacatttattgtgaatttttaaaaaacatgtaattaaggccaggcatggtggctcatacctgtaatcctagcactttgagaggctgaggtgggtggatcacctgaggtcggtagttcgagaccagcctggcccaacatggtgaaaccccatctctactaaaaatacaaaaaaaaaattagctcggcatggtggtgggcgcctgtaatcccagctactggagaggctgaagcatgagaatcacttgaacccaggaggcggaggttgcagtgagccaagatcatgccactacactccagcctgggtgactcagtgactgtctcaaaaagaaaaaaagtaattaagttctgtcatgatatatcatcattaccctttttgaacttttaaaattttttatctttagaggtaattcatataatgttcttcaatagataagtgcttttctgtcaatatatcttggagaacacaccatatcagtatttaaaactctcattcttcctatttctccacatcctctccagcacccgttgtttcctgactttttaatgattgccattctaactggtgtgagatggtatcttattgtggttttgatttgcatttctctgatggccagtgatggtgagcattttttcatgtgttttttagctgcataaatgtcttcttttgagaagtgtctgttcatgtccttcgcccactttttgatggggttgtctgtttttttcttgtaaatttgtttgagttcgttgtagattctggatattagccctttgtcagatgagtagattgcaaaaattttctcccattttgtaggttgcctgttcactctgatggtagtttcttttgctgtgcagaagctctttagtttaattagatcccagttttggcttttgttgccgttgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagtttcccagcaccatttattaaatagggaatcctttccccattgcttgtttttctcaggtttgtcaaagatcagatagttgtagatatgcggcgttatttctgagagctctgttctgttccattggtctatatctctgttttggtaccagtaccatgctgttttggtcactgtagccttgtagtatagtttgaagtcaggtagcgtgatgcctccagctttgttcttttggcttaggattgacttggcgatgcgggcttttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattgctgtataagaatgcttgtgatttttgtacattgattttgtatcctgagactttgctgaagttgcttatcagcttaaggagattttgggctgagacaatggggttttctagatatacaatcatgtaatctgcaaacagggacaatttggcttcctcttttcctaattgaatacccgttatttctttctcctgcctaattgccctggccagaacttccaacactatgttgaataggagtggtgagagagggcatccctgtcttgtgcgtgttttcaaagggaatgcttccagtttttgcccattcagtatgatattggctgtgggtttgtcatagatagctcttattattttgagatacgtcccatcaatacctcatttattgagagtttttagcatgaaggattgttgaattttgtcaaaggccttttctgcatctattgagataatcatgtggtttttgtctttggttctgtttatatgctggattacatttattgatttgcgtatgttgaaccagccttgcatcccagggatgaagcccacttgatcatgctggataagctttttgatgtgctgctggattcggtttgccagtattttattgatgatttttgcatcaatgttcatcaaggatattagtctaaaattctcttttttggttgtgtctctgcctggctttggtatcaggatgatgctggcctcataaaatgagttagggaggattccctctttttctattgattggaataatttcagaaggaatggtaccagttcctccttgtacctctggtagaattcggctgtgaatccatctggtcctggactctttttggttggtaagctattgattattgccacaatttcagagcctgttattggtccatttagagattcaacttcttcctggtttagtcttgggagggtgtatgtgtcgaggaatttatccatttcttctagattttctagtttatttgcgtagaagtgtttatagtattctctgatggtagtttgtatttctgtgggatcggtggtgatatcccctttatcattttttattgcgtctatttgattcttctctcttttcttctttattagtcttgctagcggtctatcaattttgttgatcctttccaaaaaccagctcctggattaattttttgaagggttttttgtgtctctatttccttcagctctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagaaattctggtatgttgtgtctttgttctcgttggtttcaaagaacatctttatttctgccttcatttcgttatgtacccagtagtcattcaggagcaggttgttcagtttccatgtagttgagtggttttgagtgagtttcttattcctgagttctagtttgattgcactgtggtctgagagacagtttgttataatttctgttcttttacgtttgctgaggagagctttacttccaactatgtggtcaattttggaataggtgtggtgtggtgctgaaaaaaatgtatattctgttgatgtggggtggagagttctgtaaactggttcaaccattgtggaagtcagtgtggtgattcctcagggatctagaactagaaataccatttgacccagccatcccattactgggtatatacccaaaggactataaatcatgctgctatgaagacacatgcacacgtatgtttattgcggcactattcacaatagcaaagacttggaacgaacccaaatgtccaacaatgatagactggattaagaaaatatggcacatatacaccatggaatactgtgcaaccataagaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaatggggagggatagcattaggagatatatctaatgctaaatgacgagttaatgggtgcagcacaccagcatggcacatgtatacatatgtaactaacctgcacattgtgcacatgtaccctaaaacttaaagtataataataaaataaaataagaaaaatgcaaaaattaaaaatttaaaaaaaagctctcattcttttaagcacttacaggatattcttacagatgtgtaccacgcttaatgaattgagctcttgtggatgagagtttaatttgtttctaatcatttgttatttaatagtacagtcagcatctttaggattaagtatctagaattagaactactgtgttgaagaggctattgcatttaaattgttttttttttttttttgatacggagtcttgctctgttgcccaggctggagtgcaatggcgtgatctcagctcaccgcaacctccgcctcccaggttcaagcagtgctcctgcctcagcctcctgagtagctaggattacaggcacacgccaccatgcccggctaatttttgtatttttttagtagagacggggtttcaccatgttggccaggctgatcttgaactcctgaccttgtgatctgctcgccttggcctcccaaagtgctgggattacaggcatgagccaccgtgcccgacctacatttaaattgtaaataaaagtttgctaaattgttttcagtagaggttatattaatctatatttataccaacatggagagtttgtttcctgcaaaatagccaataatttatcaaacctttgaatctttgtcaattgaatagttaaaaatgattatctcatatttgtacatttttattttattgtgaagttcagcaccttttcatgtgtttaagaacttttaattttctgttgtttatatcgtcttcccattaccattttaactatttgtttttattttcagagtttttgcttataaaattttatttacagtcaattctctttatttgtagaatctgtatttgtaaaggcacctacttgctaaaatttatttgtaacctaacatcaatactcatggcagtttcatggtttttcatggacatacacagaggtgaaaaatttgagaaccttatccagatattcccagctggggttgaacagtgctcagttttttgtgtagctttcttattataaacaagtgtccttttcgaaagcagtttatatagttctacatttttcacatttttgtgccttctgtttgtgattttactgtttaaagtgattcccaagcattgtgctgaagtgctatatagtggtattccaaggtgcatgcgggctgtgaggtgccttagagaatacatgtgttagataacctttgtttagtcatgagttatagtgctgttgagtgggagttagatgatgatgagtcatcactatttattattatattttttgagatggagtctcactctgtcacccaggctggagtgcaatggcataatctcggctcactgcaacctcctcctcccgggttcaaacgattctcctgcctcagtcttctcagtagctgggattataggcacccgccactgcacccagcataatttttgtatttttagtagaggtggggttttaccatgttgggtaggccagtcttgaactcctgacctcaagtgatccacccaccttggcatcccagagtgctgggattacagatatgagccaccatgccaggtctatatttattaaataatgtgtctttaaacagaaacagatataaaacaagcttacgtatttataagttggtgaaaatgtgaccaaaggcttacaagaacctaaccctgtatttctgttaggagcaatggctcagtattcactaatttgcgtgtttgtggcaacttcatagaacataactacctcaagtaatgagaattgactgcattctttttcaagtcattttataaacaatttacagaagaataaagggatggtgaaaattaactttgttagcaattttaatgagaatccaaatataggagacccacattttttcccatattttcccagttttgaatgtttatgtatacctaaaaggcattacatcctttgaaagcagctgtcattatgcatgaatctggaacatacctacctttaaatacggattttggatttcaaatgcatctctactatgttctaccttattatttgtattcttcatgaactcactttgtcaaaatgcaatactttttgttttttaatttatttttattttttgtagaaatagggtctcactgtgttgcccaggctggccttgaacacctggcctcaagtgatcttcctgccttccaaagtgctggggacggtaggcatgagccaccacacctgtccaaactgcaatacttctgaaaactttagggctcatagttttgttgaagtgatagatgatggctatattctttgttacataacagcaaaacatttttgtttttacatttataaataccaattagaatgactttcagtggattggttttcatttttcacatcatctttaccttcctgttactttgtgtacatatctgtctttcatacttgtccacttacaaactttttcaagtaaattctggtgttacaagcataaaagatgaaagaacgttgtcacatggtcacttgtccttttagcaattatgcgatgattcaactgttctaggtacaactagagggagagtatcccaggcaagggagataacaaatagaaaggccctaagacacaagtgtatttaacatgtttggggaacaacaaggagttaatcgtggctggagtggaagtaaggaggagagattaaggagatggagctaagagaggtagtcaagggccaggccatatgtcagcgatagtaaggtcttcagcatttacttttttaagctgggagtccatggaaaggttttgaacccaaggtatagcatgatctgacttacagaaagagacttctgattgctgtgttgaaaatacaccataggtttgaagggaggaaacaggctgactagttagagccagtgtgggtagtggtggttggatctgagtatattttccaagtggagccaccaggatttttcagtagattgattacatgtggtgtatgaaagaggagtgtcaagtgtaactccgagatttttggcttatgcaactggaaaaataaagttagaatttaatgagatggaggtctgcataaggagtacttttgtggcaggaaagaaattgggttttgaacatgtgaaaattgagatgcccattagtagaagttggatgtgaataaagagtccaggccaggtgcaatgcctcatgcctgtaatctcagcactttgggaggccaaggcaggagaatcatgtgagcccaggagttcaagaccagactgggcaacaaagtgagaccccgtctatattataaaataaaaaaatagttcagaggagaggtctgggctagagatggaaatgtagaagttagtaaatttaaagctgttgaactagaggagatagctgaggaagtgcattcaaatagagaagatgtcagaggagaactttggggttctctcagtggttagagataggatatgaggaaaaacagtgcaggagactaaggaggagctctcattgagttaggaaaatcaagagggatgccctggaagccaaatgaaggcagtgttttgaggaagaggggtgatgggccatgtgaaagccaataggtcacatgctgctaatgggtcaactaaagtgaggactgagaagtattcaccaatttagcaatgtggagctcattggtgaccctcataagagctgtgttggtggaatggaggaggtaaaatcctggagggagagaacataagaatgagagaacagttgacagtgcatgtaaacaactctttcacggaactttgtatttctgaatttttgtttatttggctattaataaaatcatatctgatatagctttattttagtaaggtttgtttttgtgggacttcagttgtgtatacacatataatatgtgtgtgtatgtatgtgcgtatggtgttttgatgtaaaatttattattgtgggtcatggttaaaaaaaaagcttgagaatgaggagttagatcaagaaatagaaggaaagttgacataagaagttgtggatgtaggagattctaccatgtagacacagtggaaggatttagggagttggagcaggttgggatatgtgatcagaaagcgggagtttagctctctcacttgcccctgcttttaccatgtgatgtgtctgctaccccttcaccttccaccatgactgtaagcttcctgaggtctccctagaagccaagcagatgccagcaccatgcttcctgtaaagcctgcagaaccatgagccaattaaacctctttgtaaattacccagtttgaggtatttctttatagcagtgcaagaatgccccaatacagaaaattggtaccgagaagttgggcattgctataaagatacctgaaaatgtggaaacagctttggaactgggtaatgagtagtggttggaagagtttacagggctcagaagaagacaggaaaatgagggtaagtttcaaacttttttttttttttttttttttttgagacggagtcttgctctgtcgcccaggctggagtgcagtggcgtgatcttggctcactgcaacctctgcctcccgggttcaagtgattttctgcctcagcttcccaagcagctggggttacaggcatgcaccaccatgcctggctaatatttttgtatttttagtaaggatggggtttcaccatgttggccaggctggtctcgaactcctgacctcaagtgattcacccacctcgacctcccaaagtgctaggtttacaggcgtgagccaccgctcccggcaagtttggaacttcttagagactagataagtggttgtgaccaaaatgctgatggtgatagggacagtgaagtccaggttgacaaggtctcaaaaggaaacgaatttattgggaactggagcaaaagtcacacgttatgccttagcaaataacttggctgcattctgcttgtgtcctagggatctgtggaagtttgaacttaaaaactatgacctagcgtatgtggcagaagaaatttctaagcagcaaagcattcaagatgtggccttctgctactaacagcctgtgctcagatgtgggggcaaatgaatgacttaaatttggaacttacatttaaacaggaagcagagcctaaaagttgggaaattttgcagcctagccaggtggtaaaaaaaaaaaccattttctccaaggaattcaagcaggctgtggagcaaccacttgctgatatttgcataactgaaagggatccaagtggtaatatccaagacaatggggaaaaggcctcaaaggcatttcagagacctatggggcagcccctcctgtcataggccctgaagccaaggaagactgaatattttcctgggctgagcccagggccctgttgccctgtgcagcctcagaacactgctccctgcatccagatggctccaactccagcaggggctcaaaggggcctaggtacagcttgggctgttactttggagggcataagccatagccttcacagcttccattaggtggtaagcctgcaggcacacagaatgcaaaaatggtgaattcttggtagcctctgcctggatttcagaggatgtatggaaaagcctgggtg

SEQ ID NO: 2 - DNA, 52073 bp, Homo sapiens
cctgtaataccagctacttgggaggctgaggcaggagaatcgcttgaacccgggaggtggagatttcagtgagccgagattgcaccactgcactccagtctgggtgacagagcaagacttcatctcaaagaaataaataaataaaaaacaaggccgggcatggtggctcatgcctataatccagcactttgggaggctgaggctgaggtgggcagatcacctgaggtcaggagttcaagaccagcctggccaacatggtgaaaccccgtctctactaaaaatacaaaaattagccaagcgtggtggtgggcgcctgtaatcccaactacttgggaggctgaggcaagagaatttcttgactctgggaggcaaaggttgcagtgagccgagactgcaccactgcactctagcctgagcaacagaacaagactctgtctcaaaaaaaaaacaaaaaaaaaaacatacaaaccgaatttccattccacatactactcttgctgttttaccacttggacaagactgcttgctggtacataagttctggaacacttccttgcagcagtctggctgagccttggtatttaaaagaaatttacctaccagcctggctataattgacataatcctattaaatacttgccttttatgaacatatatcacatgacataagtttttgtcaaatacttttttttttggtcaaagactgtagccttataccactcaagggggctgttagggtagcttatgaatggatatttcatacagagttacgtatttaacccatttcctgtttagaaaataaaagtggccaggcgccgtggctcacgcctgtaatcctagcactttgggaggccgaggtgggtggatcacgaggtcaggagatcgagaccgtcctggctaacatggtgaaaccccgtctctactaaaaatacaaaacattagccgggcatggtggcaggcgcctgtagtcccagctactcgggaggctgaggcaggagaaaggcatagacccgagaggcggagcttgcagtgagccgagatcatgccactgcactccatgcactccagcctgggcgacagagtgagactccgtctcaaaaaaaaaaaaagaaaaaaagaaaaaaaaagtgcagctggctgccagcgctcatttaattttacataaacacactctgaggttgacgcaaattaattttcaatgtgaaaatacacaaactgttcttagagttatttctaaacagaacttgtctctaatcctaatataatggaaatgtatataatgttacattaggattagaggcaagagtattcttggggcaaacgggaaatgggttagtatatacttgaagtaatataaccacatctaacctgatttcatgatatattggaatttttggttgcaagcaacaggatcagattaatgaacttactgataaaaatcttatttgaaagaatgagagactccagagtcatggaaaagttgaggactcaaggctttggaaaggtcaagaattgtaacagtttcaggtatcttaagagtaggtgttatgaggtgtttgtttttgtttttttttcttacagtgctgatatcaggttgaacttctgacatgtatatttagtttttatgtcacttggagtgcctccaactgaagttacatgggttaggtacccatccctcagcaagaggagggcaagttgatggtaaaaccaactctagtaaggagtaggtggtcccctgtattagtccgttctcatgctgataataaagacatactcgagactggataatttataaaggaaagaggtttaattgactcacagttgtgtatggctggggaggcctcaggaagcttacaatcatggcagaaggggaagcaaatacatccttcttcacatgatggcaggaaggagaagtgcaaagcaaaaggggaaaagccccttatgaaaccatcagatctcctgagaactcactcactatcatgagaacagcatgaaggtaaccacccccatgattcaattacctcccaccaggtccctcccatgacacatgggaattataggagctacaattcaggatgagatttgggttggggacacagccaaactatatcatcccccaaaaaatttagggttctttgccaaaaggaagggagaatggatgctgagcagactaaaataatatattttaatccctcttattgaaaagctaagactaaatttttaaaattgtatgtttttgtttttttgagacggagtgtcgctctgtcgcccggctggagtgcagtggcgcgatctcagctcactgcaacatccacctcccgaattcaaacaattctcccacctcagcctcctgagtagctgggactacaggagcataccaccatgcccagctaatttttgtatttttagtagagatgaggtttcaccatattggtcaggctggtctcgaactgacctcaggcaatctacccaccttggcctcccaaagtgctgggattacagacatgagccaccacgcccagctaattctgtattttaagtagagacggggtttcaccatgttggtcaggctggtctcgaactcctgacctcaggtgatccgccagccttggcctcccaaagtgctgggattacaggcgtgagccaccgagcctggctgtatttttaaatacaaaaatttgccaggtattgtgatgggtgcctgtaatctcagctactcgggaggcagaggccggagagtcacttgaacccaggaggttgcagtgagctgagatcacaccactgcactgcagcctgggtgacagaatgagactccatctaaaaaaagaaaaaaatgtattttttaaaatacatgatatggcaaatcataaaggtggtaagcatctgaagtgtgagaaataatcatgcagcttatgcagtttttgtctctaccaatctttcaaaccctcaaactgcaatgcttgctcattatagaaaatctgggaaaatacagtaagttctaaatttccataaattctaaatagcatctctttgaaaactaactccttgggcatttatcccagtgaaatgataataaacagccagcatttgaaatgtatatttcaatgactcgtatatgaatactatgttcagatcacaataaaggacatttccagcaccctcttagataatgcctcccatctgattatcaccatagattagttttgcctgtttttgaattttttgtaaatgggatcacacggtatgtgctgtagtgagcctagcttgatttgctcaacgttacgtctaaaagaattctctattttgctgctatgcagcagttcagcctttttcactgttgtgtagcattctgttatatgaatataccataatttagttactctacatttcatggacctttgaattgctcccactttggggctgttatgaataatgctaccgtaacatttttatatatcttatgatggtcttaaacacgctatctactgagtatatgccaggaatggaattgctgggtcatagggtgtgtgtctatacacacacatacacacattttttagtaggtaccatcaaacaattgcatttttgttgtttttgttttagtttgtttttaatgaccataccattttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtcccattcccctgaactaaccaatgttaataatggtatacttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccgctgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccgggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtgctgggattacaggcgtgagccactgcgcccggcagtctttccttcttttttttttttttttttttttttttaatgacatggggtcttactttattactcaggctggtctcaaacttctggcctcaaggaatcttcccaccttggcctcccaaattgctgggattacaggcataagtcatcatgcctggctacaaacagatattttcaataagaggataaaagttcatttccccatactttgctaacatcaaatgttattaattcctaatagttttgccaaactgagaggaaaatggtatgttagtttttctgggttttctttctttttaattttttttcttttttattcatcgcaacactattcacgatttttttattttttattttatttatttatttatttttttttgagacaaggtctccctatgttgcccaggctggtcttgtacccctgggctcaaaggatcctcctgcctcagcctcccaaagtgctaggattacaggcatgagtcaccacgcctggttcacaatttctttttgtttttaccaaaggcaggtatattcctgaaattttttgtttttttgttttttttttgagatgaagtctcaccctgtcactcagactggagtgcactggcacgatctcagctcactgcaacctccgcttcctaggttcaagcgattctcctgcctcagtcttcaaagtagctaggattataggcgccgcaaccatgctcagctaatttttgtatttttagtagagacaggatttcaccatgttggccagggtgatctcaaatcctgacctcaagtgatccgcctgcctcagcctcccaaagtgctgggattactggcatgagccaccgtgccaggccctgaaatgttatcttagttattaatttgcaattccttggctctagaggttgggcatcttctcagatctctagtggacatttggattttctttttggtgaactgtccagtttttctctctgctttacaatctttattatatgcaatcttcacatgtaggtactaccatttttttagtttgtttttgaaacagcatattgctctgttgcccaggctggagcacggtggcaaaaacatggcttactgcagcctttgacctccttggctcaagtactcctcctgtctcagcctcctgagtagctggtaccacaagcccataccaccatgcccagctaatttatttttgtagagatggggcctgaccatgttacttgggctcaaatgatcctctcccactcagcctcccaaagtgctaggattacaggcatgagccaccatacttggccccttttttttttttttttttttttttttttttttttttttgagacacagtcttgctctgtctcacaggctggtgtgcagtggcacgatctcagctcattgcaacctccacctcccagtttcaagtgatttttgtgcctcagcctccctagtagctgagattacaggcatgcaccaccatgcctggctgactttcatatctttagtgttgccatgttggctaggctggtctcaaactcctgacctcatgtgatccacctgcctcggactcccacagtgctgggattacaggtgttagccaccaccccgacattatttgaaacttttattttatcatgagagagttccaggagtcaactgaagagagatttttggtatgaaaattacatatgcaaaaagactgattccagtacatgaaattaaattcaacatttacattaaatgccttcaaatatggtaaaatggtttcttttggcagtttacctcattatgttttgaatgatttgtctatcatatgaaataacttttataaatatagtaactcaggcctgggcacagcggctcaagtgggaggactgcttaagcaaccgagtttgagaccagcgtggacaacatggggagaccccttctctcccaaaaaatagctgagcatggcagcgcactgttaaaggaaacagagtttctttggtgggtgattaaaatgttctggagttagatagtagtgatggttgcacaaccttgtgaatatattaaggtttccgctctatctaccattcaattgtactctctaaaacgattaattctatagtatatcaattatatctctaaataataaaaacaaaaagaaatggctgggtgcggtggctcatgcctgtaatcgcagcactttgggaggctgaggcgggcggatcacaaggtcaggagtttgagaccaacctgaccaacatggcaaaacccagtctctactaaaaatacaaaaattagctgggtgtggtggcacacgcctgtaatcccaggtactcgggaagctgagacaggagaatcacttgaacccgggaggcagaggttgcagtgagccactgcactccagtctgggtggcagagcgagactccgtctcaaaaagaaaaaaattaaaaaacaaaaagaaacctggttctatattttgtttaaatttatttttttaaccatcatgtaatatgtccaggtaatttgtttaaattttgacatcaaatgcaattgtgagaatttttatgattcagaaaaatctaagcaagctttataaaaacatacttttttttttacttttttttttttttctgagacacagcctcactctgtcgcccaggctggagggcaggttttcatgtttatctgtgagatgtacctttggcacattactttcctgacatgagatttaaatttttttttttatcttgtgacaatttaacttttttgacacataaaaattgtacatatttatttgtttgagatggagtcgcactctgtcactcaggctggagtgcagtggcgtgatcttggctcactgcaacctccgcctcccgagttcaagtgattctcctggctcagcctcccaagcagctgtcattacaggcctgcaccaccacacccggctgatttttgtatttttaggagaaacagggtttcaccatgttggccaggctggtcttgaagtcctgacctcaagtgatccacccaccttggcctcccaaagtgctgggattataggcatgagccaccgtaccagacccctaaaaattgtatatatttaaggtgtaccatttgatgtttagatatacattgtgaaatgattacattccacatattacctctacagagttaccatttttgtacacttggtcaacatcatcccattctccccttcctccacagatatttcttgtatactatatagaagccaagggtattttgggggaagagctcaaagttcctttcgtggagttaaaaatatatatatactatgtacatataagccatttagcaaccctagatgcttaataaagaatactggaggcccggtgtggtggctcacacctgtaatcccagcactttgggaggccgaggcggtcggattacgaggtcaggagttcaagaccagcctggccaacatggtgaaaccccatctttactaaaaatacaaaaattagccgggtgtggtggtgggcgcctgtaatcccagctactcggggggctgaggcagaattgcttgaacctgggaggcagaggttgcagtgagctgagatcacgccactgcattccagcctgggtgacagagcaatactctgtcgcaaaaaaaaaaaagaatactggaggctgggcgaggtggctcacacctgtaatcccagcattttgggatgccagaggcgggcggaatatcttgagctcaggagttcgagaccagcctacacaatatgctccaaacgccgcctctacaaaacatacagaaactagccgggtgtggtggcgtgcccctgtggtcctagctacttgggaggttgaggcgggaggatcgcttgagctcgggaggtcgaggctgcaatgagccgagatggtgccactgcactctgacgacagagcgagactccgtctcaaaacaaacaacaaataaggttgggggatcaaatatcttctagtgtttaaggatctgccttccttcctgcccccatgtttgtctttccttgtttgtctttatatagatcaagcaggttttaaattcctagtaggagcttacatttacttttccaagggggagggggaataaatatctacacacacacacacacacacacacacacacacacactggagttcgagacgaggcctaagcaacatgccgaaaccccgtctctactaaatacaaaaaatagctgagcttggtggcgcacgcctatagtcctagctactggggaggctgaggtgggaggatcgcttgagcccaagaagtcgaggctgcagtgagccgagatcgcgccgctgcactccagcctgagcgacagggcgaggctctgtctcaaaacaaacaaacaaaaaaaaaaggaaaggaaatataacacagtgaaatgaaaggattgagagaaatgaaaaatatacacgccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccaggtgaggtcgcagccagtgcagtctccctattagcgctctcagcacccttcttccggcccaactctccttccgcagcctcgggacagcatcaagtcgatccgctcactggagttgtggtccgcgtttttctacgtcttttcccactccgttccctgcgaaccacatccgcaagctccttcctcgagcagtttgggctccttgatagcgttgagtggaggccctgccgcgacttggcagtagcttattttgttcactcctctctggctggtgtgggggaggtgggggcattaggccagggtgaagcaggggaaccacttaggagtctgttaagatgatctgaacttcagaacaagatgttattaacagagtgaaagtatttggattctgggtatattttgaaatcggaggcaacaggtttttcagatagattcgataacggaggttatcctgaatagttgaaaagataaagttgccttttgctgaggtgggaaagagaagattgccagtagagcaggtttctcaggagttcagtcttgggcatagcatggtaggggtgaatttggctggagtgagttggagagtaggagaagagaaatccaaggcaacatttgaccagcctgggcaacatagtgtgactccgagtctgcaaaaattagacgggtgttgtggtgcgcgtctgtggtctcagctacctggaaggttcaggccttggaaggctcagggaggtggaggctgcagtgatctgtgattgcgcctctgcactccagcctgggcgacagagccagaccctgtcttaaaacaaaataaacggccgggcgcggtggctcaagcctgtaatcccagcactttgggaggccgaggcggccggatcacaaggtcaggagatcgagaccatcctggctaacacggtgaaaccccgtctctactacaaatacaaaaaattagccgggcgtggtgacgggcgcctgtagtcccagctactcgggaggctgaggcaggagaatgtcatgaagccgggaggcggagcttgcagtgagccgagatcgcgccactgcactccagcctgggcgatagagcaagactccgtctcaaataaataaataaataaataaataaataataaaaacatcggtaggcatatttcaaggaattctatttaaaaaaaatttttttagagacaagttcgctctctgtggcccaggctggagtacagtggcatgatcctagcccatggcagcgttgatctcttggcctcaagcgaccctcctttggagtcgctgggcctaaaggagtgagccaccacgaaattttattataaatggagggtagagaaattgggcaataaatggagggggaagtgagttaagaggaattttaattatgtgtgtgtggttttaaaagaggggggtcttgctctgttgcccaggctgctggggtgccagtggcgcaatcatgaatcactacagccttggactcctggcctcaagctatcctcccacctctgcctcccaaagtactgggattactagtgtgagccactgcactaagataggagcaacatgtttcagcatgtttgtgggttgataggaaagatgagaatgggaaagttgatgtcggaaagaagacaatggctagagcaatgtcctagagtaggtaagaagggatggatttggcctttgttggaaacattagcggttcttttggtgacagctatatagttaacacatctatgatacgtgaatgggcagataggatggcaggagattttgaaagttctcttgattcttactgttctcttagtgaaagaagcaaggttatcagctagaagctgggatgggagaggaaagagaagatgggaagtagatagttctttagaagagtgggcaagggttggactagggaagtttagtggaaatattgctaggcaacataaagagcctacttgagattcgtggtcatgagttgaaggagaccagacagcaagattgtgtatgagggcacccacagagtaaatggagagttgaaattaatgcagttgtgattttaccacgtggatatgaagaagtgagggggagaagtacaaaggagttctcttaatgattgaccatggaatttaagctggctaagaaaggaagtgagaggccgggcgcggtggctcacgcctgtaatcccagcactttgggagactgaggtgggtggattacctgaggtcaggagtttgagaccaacctggccgatatggcgaaaccccatctctaataaaaatacagaaaaattagccgggaatggtggcaggtgcctgtaatcccagctactcaagaggctgtggcaggagtatcccttggacccaggaggtggaggttgcagtgagccgagatcacgccactgtactccagcctggacgatatagtgagacttcacctcaaaaaaaaaaaaaaagaaaggaagtgaggattttaagaccctgagagacagtttaaaaagtgggaggatcggccgggcgctgtggctgacacctgtaatcccagcactttgggaggccgagttgggcagatcacaaggtcaggagttcgagaccagcctggccaatatggtgaaaccttgtctctactaaaaatacaaaaattagccgggcatggtgtcacgtgtctataatcccagctactcgggaggctgaggcagaaaaattgcttgaacctgggaggcagaggttgcagacagctgagatcactccattgcactccagcctgggcaacaagagcaaaactttgtctttaaaaaaaaaaaaaaaaaaagaatacaaaaattagccgggcgtggtggcgcgtgcctataatcccagctacttgggaggctgaggcaggagaatcagttgaacacgggaggcgaggtttgcagtgagccgagattgcgccactgcactccagcctgggcgacagagcaggactcctcttggaaaaaaaaaattagctgggcatggtggcaggtgcctgtagtctcagctactagggaggctgaggcaggaaaatcacttgaacccgggatgtggagtttgcagtgacccgagatcgtgccactgtactccatcctgggcgacaaaatgagactctgcctcaaaaaaaaaaaaaaaaaaaagtgggaggatcaatgtactgccagtcctaatgaagtggaatgattgtccccatcaaatcactagtaggagtaagttgcagagcctagaaggtgatggttaagagagtgggattcttgaaactgcatttatggagaggttgtggttattggttataataaataaatacagttgaagtgagtgagtagctgagatttggggatgtatcagttcattcttacactgctacaaagacatacctgagaccaggtatttataaagataagaggtttaatcagctcacagttctgctgcctgtacaggcttctcttgtggaggcctaaggaaacttacagtcatggtggaaggtgaaggggaaacaagcacagtcttcacatggccagcaggagagagagagaagggggaagtgctacatactttaaaacaaccagatcttgtgagaacgcttatcaggaaacagcacttggggatggtgctaaatcattagaaatcacccccatgatccagtcgcctcctaccatgcccacctccaacactggggatcacaattcagcatgagatttgggtaggaacacagagctgcaccacatcagaggatgtacaagattgtggtggagaggagtttagagacctgcaaatatagggtaattgaagggatcatctacatggatatttaaatcaccaaaaattatgacaggagtagtgttggagagagaactgcgatgtaaacattaaggaatgaggaagagtgactcggtaggctgtaggtgactgcaataggaaacgataatagactgtgagtctggtgacaagattttccttctttctttttttccccccccccgagacagggcctctttttgttgcccaggtgggagtgcagtggcgcgatcacggctcactacaacctcctcccaagctcaagggattctcccacttcagcctctcaagtagctggaactacaggtgctgaccaccatgcctggctactttttgtcaggattttcaaggctgggaattttgagaggggaatggaggagaataatctgaaagtgcaagtaaggagcagggaagatttcttttttcttttttttttttttttttgagtcggagtctggctcagtcgcccaggctggagtgcagtggcgagatctccgctcactgcaagctccgcctcccgtgttcacgccattctcctccttcagcctcccgagtagctgggactacaggcgcccgccaccacgcccagctaattgtttttttgtatttttagtagagacggggtttcaccgtgttagccaggatggtctcaatctcctgactttgtgatccgcccaccccggcctcccaaagcgcttgggattacaggcgtgagccaccgcgccagccagagcagggaagatttcttccccacatctccagtaggtacagtgatatgaagtgtgtggaggagaaaagaggaaacatctatcatttgagatggctgcgaaaggaaaaggcatcctcagggagctagattttacttagagcaagaaatgaagggatgattcagaggttaaaagagtggattttatgaattactcaagggagcacagtggaagtttcaggaagtggtaggagaaggtagaagatggcagggtgttgggaataatttgagaaatctgagctactggaaatgactgagaatcagatataaaggcagtcctggtggtccgttctggctgccgttgctgtgtaacgaatctgccaaaacttagtggcttgaaacaacaaagaacattttattatctctcattgtttctgtgggttaggaatttgtgagagccgtgctgggcagttttcgtgcggctgtctcgtggttgcacctacatagttgctagagctacagtagctggggactgagcagctagggattggcaggctatctctttttttcatgtagtctcatgaagatttctttatgtggtttcaatgtgtgggctggtttggatttccttatagcatggtggcctcagttggattgctgttttgtgatccttttcatccctccttgtcctgtccccagacaaccactgatctactttctgtcaccatagattagcctgcatttttaagaatttttataaacgtggaatgatagagtaccttttttgtcacgtttcttttatttatcatagctattttgattttcatccattttattgctgagtagtatcccattgcatgtatatactatactgtattcattcgcttgcttgtgaacatttgggctttttccagtttgggactgttaacaagtagagccactatgaatattagtgtataagacttcatatagccaaggctggcagatcgcttgagcccaggagtttgagaccagcctgggaaacatggtgaaacctctatttttattttaaaatcaaaaattaaaaattttctataaaaaattttaaagaagactttgtatagacatacgctttcatttttcttgagtgaatacttaggtctcagggtagatgtattttaagtctttaaggagctgtcaaactcttcctcaaagtggtggttgtaccatgttactttttaatataacagagattaattgagcaaagaaaaattcaaaagttggacagcccccacaactaaataggttcagaacagctcccccattttgcattttgaccagcaatgtatgaaagttccatttgctcagtgtccctgcaaacacctggtatggtcagtctttttaattttaggcattataatagatatagtggcttcttgtgattttaattagcatttcctaatgaccagtgctgctgttgatcatttcatgagtgtatttgccatccgtatatcttttttggtgaagtgtctattcaaatcatttgggttttttttttttttgttttttttttttggagacagtgtctcactctgtcacccaggctgttgtgcagtggtgcaatcacacagcctactgcagcctccacctcctgcgctcagtcttcttgtctcagccttctgagtagctgaaattacgagcacacgccacaatgcctggctaattttttaaaattttgtagaaacaaggtctcattatgttgcctgggcttgtcgtgaactcctgggctcaagcaatcttcctgcctcagcctcccaaagattgggattgcaagtatgagccactgcacccggccaacttacccatcttttaattgaatttttttgttgttgaggtttgagagttcttcatgtttgctgggtacaatatctttatcagataggtaacttgcatgtattttctcccggtttacactttggtttttcattttgttaacaacgtctttttaagaacagaaaatcttaattttgctgaaatctaatttttcagttttttctttgatggttttgagagaggaggtaaaaaaagactaggtaagccgatagttagacagagtcctcggtagaacttcccttctaacaaaaagcagcccaagaaatcacttctcttctaacaaggagcagcctggaagatcgggctgtaaacatgtataaggaagcagctctggcacagagggggagcttcctgggtaatcagcaagcttcacatacgtaaggtgggtatgtgaagtaaacacagtatgtgaagtaaacacagtggaccttagtacatactcagataaggaagctggaagcttgcatgttgtgagttgttggggttgcctgcagctgcacggagagaaaggggtacctggggccaggcatgtccaccatggtggctccacctccccttatttagcacatgcacaataggaaagagataagcaatgtggagtagctcaggccaaggacctgcctgcataataaaaggttggggtgggggatgccagagattcacgctctgtgcagatggcaacacctggtcctaactggttttttgctccctatgtgtagataagctacccccttcccattagctcatttataaaaatgcttgcatttcactgtggaatgggaactcttttcaggacctctctctgcaggagagagctagtctctttcttttgcctattaaacttctgctctagcctcacacccttggtgtgtcagcgtccttgatttcctcagcgtgagaccaagaacctcgggtgccaccccaggcaacaaggccatttcagtttgttcttttgttataggcaatccatgatcacagatttttctctcttttttttttttacacagtttagagttttagttttacacttaggtctgtaatccattttgtattaattcttatatgtggctcagtgtaggtggaaatttggtttgtttttgcataaggatttccaatagttttaccaccatttcttgaaactactatgctttctctattaaaccacatttgtaactttagttaaaatcagtcacatatatcacagggctatttctgactctcaattctgttacattgtctattagtgtatattgatgtcagtactacacttttaattactattgcttcagggtatgtcttgtaaaccaaaaataaaattataggccccccccgcccctgcacaaccaactgaatggacccatcctctcagccaagggcattccaaaattaacctgaaaaactagttcaagccatgatgggaagggggagttggacatgtctcatcacaccctactaccttttggaattactgatagaacagactcttaaagtctgaaaagaaacatttacaacctaccctctctgaagcctgctacctgggagcttcatctgcatgataaaaccttggtctccacaaccccttatggtaacccaaacattcctttctgttgataataactctttcaactagttgccaattagaaaatctttaaatcttcctatgacctagaaacctccctacccccactttgagttgtcctgcctttcctgacagaactcatgtacatcttacatatattgattgatgcctcatgtctccctaaaatgtataaaacaaagctgtaccccaccaccttggggacatgtcatcaggacctcctgtggctgtgtcataggagcgtctttaactttggcaaaataaactttctaaattgattgaaacctgtcttagctacttctggtttacagtcttaaagttagataatgtaaattgtccagctttggtttatttttgtccttagtagttccatataaattttagaatcagcttttcaatttaatacactactttcctcttagatccacaattaaatatatttgatgctaacaattctgttttatgtttttcgttttttttttttgagacaagagtttcgctcttgttgcccaggctggagtgcagtggcgcgatcttggctcaccacaacctccacctcccaggttcaagcaattcttctgcctcagcctcccgagtagctgggattacaggcatgcgccaccacgcccggctaattttgtatttttagtagagacggggtttcaccatgttgatcaggctggtcttgaactcctgacctcaggtgatccacccacctcggcctcccaaagtgttgggattacaggcgtgaaccaccatgcctggccagttctgttatttttaaaacccaagtttccctggtcatatcttggttggatgaagcgtattttcaatagattaccctggaaaggctagtgagtacggtattcttctacattttagacttttcttagtcttgctacttcaaggacagctaggctgcatataaaattcttggctcatactttttccccataaatttctatgagaaagtctaatgataactgattttctttattttgtaacttagtctttttgcttagaggctctctgaggatgggagggggttcttcctcccatccctaggaatttttcttttttttaaattcctaatcactagaccaccaggaagattgtttgttttgttttgtttttattcttcagggaccccatttatacatacgttaaataaatactgtttgccaatgtatcaaccattttgcttcttatttatttttgttcctttggttctttttcatggctttgctttggtgctccttagattttcagtcagatgtatttgtccttgggtaccttgtaatcagtattaccttttcttctgtcgctttgttttctgttcgttttgaaattacttgtttcctggtctggcaataacagttgagatatgaggagtttgagctgccatctgtctatgtatcttgctttaagactgcactcttctattgatatcactggccttgattttgtgatttctttatttcttcaggaccacccttcattttctactgtttgcttcctttttttttgagatggagtctcactctgtcactcaggctggagtgcagtgatcttggctcattgcaacctctgcctcccgggttccagcaattctcctgcctcagcctcccaagtatctgggactacaggtgtgcaccaccatgcccggctaagttttgtatttttaatagagacggggttttgccacattggcaggctggtctcaaactcctgatgtcaagtgatccacccaccccacccacctctgcatcccaaagtgctgggattacaggaatgagctgccgtgcccagcctcccccctacccccctttttttctttcgagacagagattataggtgtgagccactggacccagcctgtttttattccttttaccaaatctccaaggaatatcttcccttccaagtgcgaatgtaaccttaagtcagttaacctctttgtgattacttttcttatctgcaaagtgacttaatgatcttaagtactttttttttttgagacagggtctcactgtcaccctggctggagtgcagtggcacgatctctgatctccactcactgcaatctcctcttccctggttcaagcggccctcccaccttagccttctgggtagctgggactacagatgtgaaccaccacgcccagctaatttttgtactttttgtagagatggggttttgccatgttgcccaggctgggattattaagtactttttatcatacagcaagattgacattttatattggaatacatttgtctctatataacggagattaacaggaaaatgacaagcctgggtgcggtggctcatgcctgtaatcccagcactttgggaggctgaggtgggaggatcacttgaggtcaggagttcgagaccagttttgccaagatgatgaaagcccatgtctactaaaaatacaaaaattagcccagcttgatggtgggcgcctataatcccagctatttgagagactgaggcaggagaatcacttgaacctgggcagcagaggttgcagtgagccgagatcatgccactgcactccagcctgggtggcatagcgagactcttgtctcaagagaaaacaaaacaaaacaaaaaaaaaacaggaaaatgacaaaaagtaatattacaactcagtgaattttataacaaacttttttggaattcattgactaatactataccaaatccaaaatactctctagtataccaaatccaactctaccctatagtataaattggattctatttggacttgtctcactaatccctcatacagtgtgttttattttttattgaagtaaaaaaatttgtcattttaaccatttttaagtatatagttcagtaatattaagtatgttcatgttgttgcgcaatagatcttcggaagtttttcgtcttgcaacctgaaactctacccattagcaaattcccatttctccttacacttagcccttggtaatcatcattcttttttttttttttttgagatggagttttactcttgttgcccaggctggagtgcaatggtgcaatctcgactcaccacaacctccgcctcccaggttcaagcaattctacctcagcctcccgagtagctgggattacagtcatgcaccaccacgcccggctaattttgtatttttagtagagaaggggtttctccatgttgaggctggtctcgaactcctgacctcaggtgatctgcccacctcggcctcccaaagtgctgggattacaggcgtgagccactgcgcctggcccattctttctaattctataaatttgactacttagttaccttacataaataaattcttatagttagtgttatttttgcttccatgccttttttgttgttgttcatgctcttacttggaatgcgttctattttgtctacctatgcacatcctgttgggttttttttttttttgggggttttttttgtttttttttgtttttttttcccagacaaggtctcaatttgttacccaggctggagtgcagcggcgccatctccactcactgcatcctcaacttcctgggcccaggtgatcctctcgcctcagcccctgcaggtagctgggactataggcatgtgccaccatgcccagctaaatttggtttttttgtttgtttgtttttgagacagagtctcactctgtcacccaggctggagtgcagtggcacaatctcagctcactgcaatctctgccgcccgggttcaagtgattctcctgcctcagcctcccaagcagctgggattacaggtgactgccaccacgccagctaagttttgtagttttagtagagatggggtttcaccttgttggccatgctggtctcgaactcctgacctcgtgatctgcctgcttctgcctcccaaagtgctggaattacaggcatgagccaccacgcccggccagaatttttgtatttttagtagacacaaggttcttaccctgttgcctaggctggtctggaagtcctggactcaagcaattcacctgccttggcctcccaaaatgctgggattacaagccaccatgcccggcctaaatcctgttgttttgttttgttttattttgttttgttttgttttgtttgttttttgagacagagtctcgctatgtctctcaggctgtagtgcagtggcgcgatcttggctcactgccacctctgcctcccaggttcaagtgattctcctgcctcagcctcccaagtagctgggattacaggcatgtgctactatgtccggctaatttttgtatttttagtagagacagggtttcaccatgttggccaggctggtctcgaactcctgacctcgtgatccacccacctcggccacccaaagtgctgggattacaggcgtgagtggtttttatttcttaggccggtttcctccatatgatcttgcagtagacattaatttctttcctttttaattaaaatactgtttgtatttcacattttgatgtttgttaagatttgttttatattgttttttgttttgtcttgtgtgatagtcttaaatccctagttagataataactggagagtaccatgtttctatatatctctcagtgacttgcacagtgctagcagatagtgctaaaaaattatttattattattattattttgttattgttgttgttgttgttagacagggtcttcctctgtcacccaggctagagggcaatgggatgatcatagcttactgcagcctccaacaactgggctcatgtaattctcctgcctcagcttcccaagtagctgggattacaggcatgagccaccatgtctggacaaaaatatttccaggtgcagtggctcatgcctgtaattcccacacttgggaggccgagcgaggctggaggatcacttgagcctaggagttcaagaccagcttggctaagatggcgagaccccgtccctacaaaaaattttaaaaactagccaggcatggtggcatgcacctatattcccaactactcagtgggctgaggtgggagggtcatttgaacacaggaatttgaggggagaaaaaaagaagagagaaagagaagtgaaggaaggaagaaaggaaggagggagggagagaagaaagaaacgaaagaaaggaaaagaaaaggaaggaaagaaaattggtaccaggaaagcaggaaagggaaatggaagtaaaaaaataataataataataaaatgaaaattggttagtcactattaacaatttgtatccttataatctggaaacattataatttcaaaagaaaaaatattctttggatcataggttctgaggtcagaacagcattcccgtagtctagatgaagtcaagttttatctgatcttaattgaaataaatatagctggccttgaacaaatctactcatggtatgtggataggaattaaattgtaggggcattcacttgatggcattcattcttagaacatttacctatgtctagcttttggagtaaagtcacataacctctaaccaggtaagtttcctgtggctttatttaggattttaaatactcattttcagtgtaattttgttatgtgtggattaagatgactcttggtactaacatacattttctgattaaacctatctgaacatgagttgtttttatttcttaccctttccagagcgatgattctgacatttgggatgatacagcactgataaaagcatatgataaagctgtggcttcatttaaggtatgaaatgcttgcttagtcgttttcttattttctcgttattcatttggaaaggaattgataacatacgataaagtgttaaagtacatgttattcagttttcattttgaagattagatggtagtatgagttagttaaatcaggtgatatcctcctttagaagttgatagcctatatatgtcatcctttgtggaggcaatttaaataaaatttaaaacatttattcctggctgggtatggtggctcactcctgtaatcccagcactttgagaggctgaggcgggtggatcacctgaggtcaggagtttgagaccagcctggccaacatggtgaaaccccgtctttactaaaaatacaaaaattagccaagcatggtggcacgtgcctgtaatcccagctgcttgggacactgaggcaggagaattgcttgaacctggggggcagaggttgcaatgattgcaccactgcactccagcctgggcgatagagtgagactccatctcagaaaacgaacaaacaatgtattccttttagtatttttacattgtatcaaactatggaagtcctctaattgagattaataagaaaaagacaatctgaattataattttaaacatttaacaagcatgtagtaaaataatgatgaagataaatagcattagtacagcaattaatatttgtagcatgctgacagtgctctgtgtgcgtttcatatattaaattactctaatcatcccaaatcctgtaagttgggtatcaattcaagtgttcctattgggtaggaatatacagttcttttaggaaatgtagtatggttctgtgtctcaaacaggacacttacacagttggccaacatcatcaccttctccattctctgagatgtttagtcttactgagcactaaatatgggtcatcaatagtccagactaccttgagcaaacaatagtccagactaccttgagcaaacagagcatatactcatacagtgtataaagagcaccaagcatacagatttcatgtctttctcatagttactcttgtaacatgagctaaagatcagacctctatgtcacctttgtaactgatttctagatttttttttttttttgagatggggtcttgccctgtcacccaggctggagtgtagtggcgtgatcatgcctcattggagccttcaactcatgagctcaaacaatcctcctacctcagcttcctgagtagttgggaccacaggtgtgtgccaccacacccagctcatttttgtattctttgtagagatgcagtctcaccctgttgcccacgctggcctggaactcctgagctcaaaagatccctccgccttgaccttccaaagtgctgggattacaagcatgaaccactgcacccggcctagatttttaaatgtgctttccagtatacactgaaactagaagtcgactaaagaattaccaagagaattctataaaatagagattgaaatggggctcgatgtgggatgggttggtgatattgcagggagaagtaatctgagtaaaggaggaaaagaactgatttgggaaaacgatagttttagtagtgagtttgagtatgaattaagttgagattgaatttgaattaagttgaggttgaatatgaattaagttgaggttgagtttgaggtatgaattaagatgtgaaattgatcattggaaatgttagattgagaaaagtcacagctggattaatagcttcagaagtgtgtttgcagacagttgcaactaaagtaataagaatagatggccttggccgggcgcggtggctcacgcctgtaatcccagtactttgggaggctgaggcgagcaaatcacgaggtcaggagttcaagaccagcctggcccacatggtgaaaccccgtctttattaaaaatacaaaaattagctgtgcacagtggtgcacgcctgtaatcccagctactcgggaggctgagacaggagaatcgcttgaacctgggaggtggaggttgcagtgagctgagatcagtgtgactgcactccagcccggtgacagagtgagactctgtgtaaaaaaataaaataaataaaataatggccgtaagcaagtaaagaaggatggccagctcttattgggaatgcctaaatctaaggcttgatcagaagtaatgaaaccgttggggccctacattgctatgacatccaaagggccatgaatatcaggaagaaagataattaacagggtctaatgttacagagaggttgagagcaaggagatttgattaaaagggtctttagagctgatgtcaggtgtatgatgcctttaagagcagtttttatagtgcagggggtggtcaaaagagaaaataggtgctttctgaggtgacggagccttgagactagcttatagtagtaactgggttatgtcgtgacttttattctgtgcaccaccctgtaacatgtacatttttattcctattttcgtagcatgctctaaagaatggtgacatttgtgaaacttcgggtaaaccaaaaaccacacctaaaagaaaacctgctaagaagaataaaagccaaaagaagaatactgcagcttccttacaacaggttattttaaaatgttgagatttaacttcaaaggatgtctcattagtccttatttaatagtgtaaaatgtctttaacttaagtgattagtacagtgtttctattgacatatacttatacaacttcaaaaacaactattaaattttctgttatttaggaacatgcatattagtcatgaaagtataaagaattagatgggaatgataaatgctaaaatcaggacatgtgttccatttgtgaatggaaggcagggagaaggtgccgtttggaaggagtacccaagagccgtaagctgaattggcagtgttttacatcttaagctgagagatagatttttttttcccctttttctttaaaaactctaaaactgttaattccaaggaacccagaagtctaggtagattatttctgctagttaaaagcagtagtcctgaaagctgaatattttggtgtcttttgagccaactttagtttcatcattaccaagggggaagagagctaacagttgatgagcacttgctctaggccagtccagagtgctgggcaccatacgcattttatctccctcccgctattcacaacaaatatgggaggtagtttatattatagccatctaataagatggggaaactaagactcaaagagattcagaaacttgtccatgattataaatgtaagagagttggaattcagatttatgtatttagaccccaagcctttctcattacatcattttgccttccaaatctctaccctctatccttcacctccccactgatcaaaacgagatgatagtttgccctcttcaaaagaaatgtgtgcatgtatatatctttgatttcttttgtagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagaggtaaggatacaaaaaaaaaaaaattcaatttctggaagcagagactagatgagaaactgttaaacagtatacacagttgtcagtttgatccaccgaggcattaattttttcttaatcacacccttataacaaaaacctgcatattttttctttttaaagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaaggtaaaccttctatgaaagttttccagaaaatagttaatgtcgggacatttaacctctctgttaactaatttgtagctctcccatgaaacttttgtagcttaaatacacaagaattttttgaaaaggaaataagataatgatgcaaaatagttaattttttaaaaaaatgttagacactgcagtggatgcaacaaaatactttatatgaaagatttatccagttaacttttgtggagtattaggtattagactaataattagcacacttacttaagttagaaagtataataatgcgccggacgcggtagctcacgcctgtaatcccagcactttgggaggccaaggtgggcggatcacaaggtcaggagatcgagaccatcctggctaacacggtgaaaccccatctctactgaaaatacaaaaaaatttgccgggcgtgatggcgggcacctgtagtcccagctactcgggaggctgaggcaggaggatggtgtgaaccccggaggcagagcttgcagtgagtcaagatcgtgccactgcactccaacctgggcgacagaatgagactccatctcaaacaaaaaaacaaaacaaaacaaaaaaaagtgtaataataatttatcattagctggatgatatgctgttgtttcccatgtcacctgtataagatatgtaaaataagaacacattatttacatctaatatagataaaatcctgaggcgctctcagattgttttgtagagttcaaatgtaaatattgttttcatttatggtccttttggttataagtaacagaaatcaactctaaaaagatttttattataggttagattatgtcatggaaccttaaggcttgtccctttctagttcttttgtgtaaagcggtgatttcttccatggagggaatggtatttaggcaatttttttttttttttcgagatggagtcttgctctgtcgctcaggctggagtgcagtggcaccatttcagctcactgcaacttccacctcctgggttcaagtgattctcctgcttcagcctcccaagtagctgagattacaggcacccgccaccacacccggcttattttgtatttttagtagagatggggtttcaccatgttggccaggctggtcttgaactcctgacctcaagtgatctccccaccttggccttccaaagtgctaggattacaggcgcctagcctaggcagtcattttcaaaaaacaagcatgactcaccaaaagttttaagattttctgtgataatgttcttattgaggcttacattatattacagtttcttgaatctaaaatgatgtaccctcttagaatatatacatcatgcttcattggtctcagggggctgatttttataaggagagatttgctagttttcacaatatgtcctctaagttggcatgtatagctaaacaggctttcataaaaatatacaatttagttaatgaaatttgggatatagtcttttatgattgaaataattttgctaaatagactgtctctgatttattaggtaatcaccactcttattttgttttacttccttaatgtctacatagaaaggaaatgagaaaaatccagaggttgtcatttgacttatgagtctgtttgacttcaggatttggtacatgaaatttcacttaatctttttgatatgtataaaacaaatattctgggtaattatttttatccttttggttttgagtcctttttattcctatcatattgaaattggtaagttaattttcctttgaaatattccttatagccaggtctaaaattcaatggcccaccaccgccaccgccaccaccaccaccccacttactatcatgctggctgcctccatttccttctggaccaccagtaagtaaaaaagagtataggttagattttgctttcacatacaatttgataattagcagaatagaggattgtaaaatgtcattgtagaacatcccttgggccagattctaatgggtagaaatttgaactaaacctctgggttttgtttgtttttaatgcctttctgttacccagatgcagtgctcttgtagtcccaagtctaagctctaggttgccttctttcctggcagaagttggtgtctatgccataaggaggtagttcctgttagaagggatttaattataccttatataaggaattagtgtttgcccttctaggtatagttggatgttagcttctgatgtaaactggatttctttttctttctctctctttttttttttttgttttggaggcagagttttgcccttgtaccccaggctggagtgcagtggtgtgatctcagctcacagcaacctccgcctcctgggttcaagcaattctgcctcggcctcccaagtagctgggattacaggcgactgccaccacacccggctaatttttgttttattagtagagatggggtttcaccatgttggccagactgatcttgaactcctgacctcaggtgatccacccgccttggcctcccaaagcgctgggattacaggcgtgagctgccgcacccagctgtaaactggatttctaatggtagatttttaggtattaacaatagataaaaagatactttttggcatactgtgtattgggatggggttagaacaggtgttctacccaagacatttacttaaaatcgccctcgaaatgctatgtgagctgtgtgtgtgtgtgtgtgtgtgtgtgtattaaggaaaagcatgaaagtatttatgcttgattttttttttttactcatagcttcatagtggaacagatacatagtctaaatcaaaatgtttaaactttttatgtcacttgctgtcttttcgtcctcgttaaatttaattttgttggtcttttgttgttattggttggttttctccaaatgctagctatgttaagaaatttaaggccaggtacagtggctcatgcctgtaatcccggcattttagaaggctgaggcaggaggatcacttgagctcaggagtttgagaccagtctgggcaacatagcaagacctcgtctttgtttaggggaaaaaaaagaaatttaagtaggagattatataagcaaaaatacaattaatttccagcattcactatataatataaatctccagactttacttttttgtttactggatataaacaatatctttttctgtctccagataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattactaaaaaataaaaataaaaaaatacaactgtctgaggcttaaattactcttgcattgtccctaagtataattttagttaattttaaaaagctttcatgctattgttagattattttgattatacacttttgaattgaaattatactttttctaaataatgttttaatctctgatttgaaattgattgtagggaatggaaaagatgggataatttttcataaatgaaaaatgaaattcttttttttttttttttttttttgagacggagtcttgctctgttgcccaggctggagtgcaatggcgtgatcttggctcacagcaagctctgcctcctggattcacgccattctcctgcctcagcctcagaggtagctgggactacaggtgcctgccaccacgcctgtctaattttttgtatttttttgtaaagacagggtttcactgtgttagccaggatggtctcaatctcctgaccccgtgatccacccgcctcggccttccaagagaaatgaaatttttttaatgcacaaagatctggggtaatgtgtaccacattgaaccttggggagtatggcttcaaacttgtcactttatacgttagtctcctacggacatgttctattgtattttagtcagaacatttaaaattattttattttattttattttttttttttttttgagacggagtctcgctctgtcacccaggctggagtacagtggcgcagtctcggctcactgcaagctccgcctcccgggttcacgccattctcctgcctcagcctctccgagtagctgggactacaggcgcccgccaccacgcccggctaatttttttttatttttagtagagacggggtttcaccgtggtctcgatctcctgacctcgtgatccacccgcctcggcctcccaaagtgctgggattacaagcgtgagccaccgcgcccggcctaaaattatttttaaaagtaagctcttgtgccctgctaaaattatgatgtgatattgtaggcacttgtatttttagtaaattaatatagaagaaacaactgacttaaaggtgtatgtttttaaatgtatcatctgtgtgtgcccccattaatattcttatttaaaagttaaggccagacatggtggcttacaactgtaatcccaacagtttgtgaggccgaggcaggcagatcacttgaggtcaggagtttgagaccagcctggccaacatgatgaaaccttgtctctactaaaaataccaaaaaaaatttagccaggcatggtggcacatgcctgtaatccgagctacttgggaggctgtggcaggaaaattgctttaatctgggaggcagaggttgcagtgagttgagattgtgccactgcactccacccttggtgacagagtgagattccatctcaaaaaaagaaaaaggcctggcacggtggctcacacctataatcccagtactttgggaggtagaggcaggtggatcacttgaggttaggagttcaggaccagcctggccaacatggtgactactccatttctactaaatacacaaaacttagcccagtggcgggcagttgtaatcccagctacttgagaggttgaggcaggagaatcacttgaacctgggaggcagaggttgcagtgagccgagatcacaccgctgcactctagcctggccaacagagtgagaatttgcggagggaaaaaaaagtcacgcttcagttgttgtagtataaccttggtatattgtatgtatcatgaattcctcattttaatgaccaaaaagtaataaatcaacagcttgtaatttgttttgagatcagttatctgactgtaacactgtaggcttttgtgttttttaaattatgaaatatttgaaaaaaatacataatgtatatataaagtattggtataatttatgttctaaataactttcttgagaaataattcacatggtgtgcagtttacctttgaaagtatacaagttggctgggcacaatggctcacgcctgtaatcccagcactttgggaggccagggcaggtggatcacgaggtcaggagatcgagaccatcctggctaacatggtgaaaccccgtctctactaaaagtacaaaaacaaattagccgggcatgttggcgggcaccttttgtcccagctgctcgggaggctgaggcaggagagtggcgtgaacccaggaggtggagcttgcagtgagccgagattgtgccagtgcactccagcctgggcgacagagcgagactctgtctcaaaaaataaaataaaaaagaaagtatacaagtcagtggttttggttttcagttatgcaaccatcactacaatttaagaacattttcatcaccccaaaaagaaaccctgttaccttcattttccccagccctaggcagtcagtacactttctgtctctatgaatttgtctattttagatattatatataaacggaattatacgatatgtggtcttttgtgtctggcttctttcacttagcatgctattttcaagattcatccatgctgtagaatgcaccagtactgcattccttcttattgctgaatattctgttgtttggttatatcacattttatccattcatcagttcatggacatttaggttgtttttatttttgggctataatgaataatgttgctatgaacattcgtttgtgttctttttgtttttttggttttttgggttttttttgttttgtttttgtttttgagacagtcttgctctgtctcctaagctggagtgcagtggcatgatcttggcttactgcaagctctgcctcccgggttcacaccattctcctgcctcagcccgacaagtagctgggactacaggcgtgtgccaccatgcacggctaattttttgtatttttagtagagatggggtttcaccgtgttagccaggatggtctcgatctcctgacctcgtgatctgcctgcctaggcctcccaaagtgctgggattacaggcgtgagccactgcacctggccttaagtgtttttaatacgtcattgccttaagctaacaattcttaacctttgttctactgaagccacgtggttgagataggctctgagtctagcttttaacctctatctttttgtcttagaaatctaagcagaatgcaaatgactaagaataatgttgttgaaataacataaaataggttataactttgatactcattagtaacaaatctttcaatacatcttacggtctgttaggtgtagattagtaatgaagtgggaagccactgcaagctagtatacatgtagggaaagatagaaagcattgaagccagaagagagacagaggacatttgggctagatctgacaagaaaaacaaatgttttagtattaatttttgactttaaattttttttttatttagtgaatactggtgtttaatggtctcattttaataagtatgacacaggtagtttaaggtcatatattttatttgatgaaaataaggtataggccgggcacggtggctcacacctgtaatcccagcactttgggaggccgaggcaggcggatcacctgaggtcgggagttagagactagcctcaacatggagaaaccccgtctctactaaaaaaaatacaaaattaggcgggcgtggtggtgcatgcctgtaatcccagctactcaggaggctgaggcaggagaattgcttgaacctgggaggtggaggttgcggtgagccgagatcacctcattgcactccagcctgggcaacaagagcaaaactccatctcaaaaaaaaaaaaataaggtataagcgggctcaggaacatcattggacatactgaaagaagaaaaatcagctgggcgcagtggctcacgccggtaatcccaacactttgggaggccaaggcaggcgaatcacctgaagtcgggagttccagatcagcctgaccaacatggagaaaccctgtctctactaaaaatacaaaactagccgggcatggtggcgcatgcctgtaatcccagctacttgggaggctgaggcaggagaattgcttgaaccgagaaggcggaggttgcggtgagccaagattgcaccattgcactccagcctgggcaacaagagcgaaactccgtctcaaaaaaaaaaggaagaaaaatatttttttaaattaattagtttatttattttttaagatggagttttgccctgtcacccaggctggggtgcaatggtgcaatctcggctcactgcaacctccgcctcctgggttcaagtgattctcctgcctcagcttcccgagtagctgtgattacagccatatgccaccacgcccagccagttttgtgttttgttttgttttttgttttttttttttgagagggtgtcttgctctgtcccccaagctggagtgcagcggcgcgatcttggctcactgcaagctctgcctcccaggttcacaccattctcttgcctcagcctcccgagtagctgggactacaggtgcccgccaccacacccggctaatttttttgtgtttttagtagagatggggtttcactgtgttagccaggatggtctcgatctcctgaccttttgatccacccgcctcagcctccccaagtgctgggattataggcgtgagccactgtgcccggcctagtcttgtatttttagtagagtcgggatttctccatgttggtcaggctgttctccaaatccgacctcaggtgatccgcccgccttggcctccaaaagtgcaaggcaaggcattacaggcatgagccactgtgaccggcaatgtttttaaattttttacatttaaattttattttttagagaccaggtctcactctattgctcaggctggagtgcaagggcacattcacagctcactgcagccttgacctccagggctcaagcagtcctctcacctcagtttcccgagtagctgggactacagtgataatgccactgcacctggctaatttttatttttatttatttatttttttttgagacagagtcttgctctgtcacccaggctggagtgcagtggtgtaaatctcagctcactgcagcctccgcctcctgggttcaagtgattctcctgcctcaacctcccaagtagctgggattagaggtccccaccaccatgcctggctaattttttgtactttcagtagaaacggggttttgccatgttggccaggctgttctcgaactcctgagctcaggtgatccaactgtctcggcctcccaaagtgctgggattacaggcgtgagccactgtgcctagcctgagccaccacgccggcctaatttttaaattttttgtagagacagggtctcattatgttgcccagggtggtgtcaagctccaggtctcaagtgatccccctacctccgcctcccaaagttgtgggattgtaggcatgagccactgcaagaaaaccttaactgcagcctaataattgttttctttgggataacttttaaagtacattaaaagactatcaacttaatttctgatcatattttgttgaataaaataagtaaaatgtcttgtgaaacaaaatgctttttaacatccatataaagctatctatatatagctatctatatctatatagctattttttttaacttcctttattttccttacagggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaatattaaagaattttgatgccaaaactattagataaaaggttaatctacatccctactagaattctcatacttaactggttggttgtgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattagctgtatctgtgattgtatttcttttttgcatattattttgccctttggcccatattttgatatggatgccaccatagcattttgtgtatgtgcatgtgtattcccacttaatgtcacatttttcatgtctttacatattcttatttttgtttgtttttgagacagagtctcgctctgctgcccacgctggagtgcagtggtgcaatctcagctcactgcaacctctgctatccgggttcaagcagttctcgtgcctcacccacgtgagtagttgggattacaggcatgtggcaccatgccccactaagttttgtatttttagtagagatggagtttcaccatgttggccaggctggtctcaaactcctgccctcaagtgattcgaccaccctggcctcccaaagtgctgggattacagccgtgagccaccgcacacggcctctctatttatttctatacatagcttttcacattatattatgtttatatattgtttatatctgtatttcctctttcattagagaaaaggtagtacatcttattcttcatggtgtctacaatatctggcagtttttggaagtcaagcgtgagcttagagcatagactggtgggattgtcaaagaagagggcaactggaagagaactgtcagttatttttggatcagtctttaattcatcatgacgggttaggcattagttgtatttcttgctaattttgaagaagacttattaacaaatcctacattaggtaaatggttttgaaagttgagttaatcataatggtgtttgacctaggactatttttaggccctatttatcttaatatcgaataatgaagcagcttcccccttagatatagacagaaaacatcaaagccaccacactacctggctggatttatcctagtaataaaatcaaaactgagctagttctctggctttcattgtaataattgtccttgtggttgtaaggaatctagatgaaaattacatggtctgttctacagccacagctgtacctacattcagaagacagacaaaagttgctgtgtttgaagagatccttcattaagggatcagacagagattactttgagacatattctaagtttaacttttctgcagggttgccattaacagaaataaactacagagttaatttctttttgtttttgatacagtctaactctcacccaagctggagtgcagtggcgcaatttcagctcactgcaacctctgcctcccaggttcaagcaattctcctgcctcagcctcccgagcagctgggactacaggcatgtgccactatgcctggctaatttttgtatttttagtagtagagacgtggtttcgccacgttggccaggctggtctggaactcctgaccccaggtaatccacctgcctcggcctcccaaagtgctgggattacaagcttgagccactacgcctgacccagagttaactttttaaaaaagtttttatgaacttaagtcttgtgatgtttgaaataatggattcaatttagacatcaaattccagaagttactaagagcagctgggcgcggcagctcacacctgtaatcccagcactttgggaggccgaggcgggtggatcacctgagatcaggagttccagaccagcctggccaacatagtaaaaccctgtctctactaaaaatacaaaaattagcccggcatggtggcacgccctgtagtcccagctacttgggaggctgaggcaggagaattgcttgaacccgggaggtggaggttgtggtgagccgagattgtgccactgtactcaagcctgggctaaaaagcgagactccgtctcaaaaaaaaaaaaaaaaaaaacacgttactaagagcaactctgggccaggcacggtggcttacacctgtaatcccagcattttgggaggacgagacaggcggatcacttgagcccaggagttcaagaccagcataagcaacaacgcaaaacccctgactctacaaaacatgaaagaattagcaaggcatggtggtgcatgcctgtagtcccagctactggagaggctgaggcaaaaggatcacttgagtacaggaggttgaggctgtgtaatgagccgtgttcacaccattgcacttcagcctgggcaacagactgagaccctgtctcaaaaaaaaaaaccaaaccaaagcaacaaacaaaaaacaagagcaactctgcttctgtacacttttttttttttttttggtagtgacatgatctatgttgcccaagctggtctcgagttcctgggttcaagccattctcccacctcgggctcccaaagtgctaggattacaggcatgaatcaccatgcccagcccttctgtacacttttcacagtgtacccttttgtgttttttaaaatgtttgtgtatacatttattgtgaatttttaaaaaacatgtaattaaggccaggcatggtggctcatacctgtaatcctagcactttgagaggctgaggtgggtggatcacctgaggtcggtagttcgagaccagcctggcccaacatggtgaaaccccatctctactaaaaatacaaaaaaaaaattagctcggcatggtggtgggcgcctgtgatcccagctactggagaggctgaagcatgagaatcacttgaacccaggaggcggaggttgcagtgagccaagatcgtgccactacactccagcctgggtgactcagtgactgtctcaaaaagaaaaaaagtaattaagttctgtcatgatatatcatcattaccctttttgaacttttaaaattttttatctttagaggtaattcatataatgttcttcaatagataagtgcttttctgtcaatatatcttggagaacacaccatatcagtatttaaaactctcattcttcctatttctccacatcctctccagcacccgttgtttcctgactttttaatgattgccattctaactggtgtgagatggtatcttattgtggttttgatttgcatttctctgatggccagtgatggtgagcattttttcatgtgttttttagctgcataaatgtcttcttttgagaagtgtctgttcatgtccttcgcccactttttgatggggttgtctgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccagttttggcttttgttgccgttgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagtttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattgctgtataagaatgcttgtgatttttgtacattgattttgtatcctgagactttgctgaagttgcttatcagcttaaggagattttgggctgagacaatggggttttctagatatacaatcatgtaatctgcaaacagggacaatttggcttcctcttttcctaattgaatacccgttatttctttctcctgcctaattgccctggccagaacttccaacactatgttgaataggagtggtgagagagggcatccctgtcttgtgcgtgttttcaaagggaatgcttccagtttttgcccattcagtatgatattggctgtgggtttgtcatagatagctcttattattttgagatacgtcccatcagtacctcatttattgagagtttttagcatgagggattgttgaattttgtcaaaggccttttctgcatctattgagataatcatgtggtttttgtctttggttctgtttatatgctggattacatttattgatttgcgtatgttgaaccagccttgcatcccagggatgaagcccacttgatcatgctggataagctttttgatgtgctgctggattcggtttgccagtattttattgatgatttttgcatcaatgttcatcaaggatattagtctaaaattctcttttttggttgtgtctctgcctggctttggtatcaggatgatgctggcctcataaaatgagttagggaggattccctctttttctattgattggaataatttcagaaggaatggtaccagttcctccttgtacctctggtagaattcggctgtgaatccatctggtcgtggactctttttggttggtaagctattgattattgccacaatttcagagcctgttattggtccatttagagattcaacttcttcctggtttagtcttgggagggtgtatgtgtcgaggaatttatccatttcttctagattttctagtttatttgcgtagaagtgtttatagtattctctgatggtagtttgtatttctgtgggatcggtggtgatatcccctttatcattttttattgcgtctatttgattcttctctcttttcttctttattagtcttgctagcggtctatcaattttgttgatcctttccaaaaaccagctcctggattaattttttgaagggttttttgtgtctctatttccttcagctctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagaaattctggtatgttgtgtctttgttctcgttggtttcaaagaacatctttatttctgccttcatttcgttatgtacccagtagtcattcaggagcaggttgttcagtttccatgtagttgagtggttttgagtgagtttcttattcctgagttctagtttgattgcactgtggtctgagagacagtttgttataatttctgttcttttacgtttgctgaggagagctttacttccaactatgtggtcaattttggaataggtgtggtgtggtgctgaaaaaaatgtatattctgttgatgtggggtggagagttctgtaaactgcttcaaccactgtggaagtcagtgtggcgattcctcagggatctagaactagaaataccatttgacccagccatcccattactgggtatatacccaaaggactataaatcatgctgctatgaagacacatgcacacgtatgtttattgcggcactattcacaatagcaaagacttggaaccaacccaaacgtccaacaatgatagactggattaagaaaatatggcacatatacaccatggaatactatgcaaccataagaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactcttgggactgttgtggggtggggggagtggggagggatagcattaggagatatacctaatgctaaatgaggagttaattggtgcagcacaccagcatggcacatgtatacatatgtaactaacctgcacattgtgcacatgtaccctaaaacttaaagtataataataaaataaaataagaaaaatgcaaaaattaaaaatttaaaaaaaagctctcattcttttaagcacttacaggatattcttacagatgtgtaccacgcttaatgaattgagctcttgtggatgagagtttaatttgtttctaatcatttgttatttaatagtacagtcagcatctttaggattaagtatctagaattagaactactgtgttgaagaggctattgcatttaaattgttttttttttttttttgatacggagtcttgctctgttgcccaggctggagtgcaatggcgtgatctcagctcaccgcaacctccgcctcccaggttcaagcagtgctcctgcctcagcctcctgagtagctaggattacaggcacacgccaccatgcccggctaatttttgtatttttttagtagagacggggtttcaccatgttggccaggctgatcttgaactcctgaccttgtgatctgctcgccttggcctcccaaagtgctgggattacaggcatgagccaccgtgcccgacctacatttaaattttaaacaaaagtttgctaaattgttttcagtagaggttatattaatctatatttataccaacatggagagtttgtttcctgcaaaatagccaataatttatcaaacctttgaatctttgtcaattgaatagttaaaaatgattatctcatatttgtacatttttatcttattgtgaagttcagcaccttttcatgtgtttaagaacttttaattttctgttgtttatatggtcttcccattaccattttaactatttgtttttattttcagagtttttgcttataaaattttatttacagtcaattctctttatttgtagaatctgtatttgtaaaggcacctacttgctaaaatttatttgtaacctaacatcaatactcatggcagtttcatggtttttcatggacatacacagaggtgaaaaatttgagaaccttacccagatattcccagctggggttgaacagtgctcagttttttgtgtagctttcttactataaacaagtgtcctttttgaaagcagtttatatagttctacatttttcacatttttgtgccttctgtttgtgattttactgtttaaagtgattcccaagcattgtgctgaagtgctatatagtggtattccaaggtgcatgcgggctgtgaggtgccttagagaatacatgtgttagataacctttgtttagtcatgagttatagtgctgttgagtgggagttagatgatgatgagtcatcactatttattattatattttttgagatggagtctcactctgtcacccaggctggagtgcaatggcataatctcggctcactgcaacctcctcctcccgggttcaaacgattctcctgcctcagtcttcccagtagctgggattataggcacccgccactgcacccagcgtaatttttgtatttttagtagaggtggggttttaccatgttgggtaggccagtcttgaactcctgacctcaagtgatccacccaccttggcatcccagagtgctgggattacagatatgagccaccatgccaggtctatatttattaaataatgtgtctttaaacagaaacagatataaaacaagcttacgtatttataagttggtgaaaatgtgaccaaaggcttacaagaacctaaccctgtatttctgttaggagcaatggctcagtattcactaatttgcgtgtttgtggcaacttcatagaacataactacctcaagtaatgagaattgactgcattctttttcaagtcattttataaacaatttacagaagaataaagggatggtgaaaattaactttgttagcaattttaatgagaatccaaatataggagacccacattttttcccatattttcccagttttgaatgtttatgtatacctaaaaggcattacatcctttgaaagcagctgtcattatgcatgaatctggaacatacctacctttaaatacggattttggatttcaaatgcatctctactatgttctaccttattatttgtattcttcatgaactcactttgtcaaaatgcaatactttttgttttttaatttatttttattttttgtagaaatagggtctcactgtgttgcccaggctggccttgaacacctggcctcaagtgatcttcctgccttccaaagtgctggggacggtaggcatgagccaccacacctgtccaaactgcaatacttctgaaaactttagggctcatagttttgttgaagtgatagatgatggctatattctttgttacataacagcaaaacatttttgtttttacatttataaataccaattagaatgactttcagtggattggttttcatttttcacatcatctttaccttcctgttactttgtgtacatatctgtctttcatacttgtccacttacaaactttttcaagtaaattctggtgttacaagcataaaagatgaaagaacgttgtcacatggtcacttgtccttttagcaattatgcgatgattcaactgttctaggtacaactagagggagagtatcccaggcaagggagataacaaatagaaaggccctaagacacaagtgtatttaacatgtttggggaacaacaaggagttaatcgtggctggagtggaagtaaggaggagagattaaggagatggagctaagagaggtagtcaagggccaggccatatgtcagcgatagtaaggtcttcagcatttacttttttaagctgggagtccatggaaaggttttgaacccaaggtatagcatgatctgacttacagaaagagacttctgattgctgtgttgaaaatacaccataggtttgaagggaggaaacaggctgactagttagagccagtgtgggtagtggtggttggatctgagtatattttccaagtggagccaccaggatttttcagtagattgattacatgtggtgtatgaaagaggagtgtcaagtgtaactccgagatttttggcttatgcaactggaaaaataaagttagaatttaatgagatggaggtctgcataaggagtacttttgtggcaggaaagaaattgggttttgaacatgtgaaaattgagatgcccattagtagaagttggatgtgaataaagagtccaggccaggtgcaatgcctcatgcctgtaatctcagcactttgggaggccaaggcaggagaatcatgtgagcccaggagttcaagaccagactgggcaacaaagtgagaccccgtctatattataaaataaaaaaatagttcagaggagaggtctgggctagagatggaaatgtagaagttagtaaatttaaagctgttgaactagaggagatagctgaggaagtgcattcaaatagagaagatgtcagaggagaactttggggttctctcagtggttagagataggatatgaggaaaaacagtgcaggagactaaggaggagctctcattgagttaggaaaatcaagagggatgccctggaagccaaatgaaggcagtgttttgaggaagaggggtgatgggccatgtgaaagccaataggtcacatgctgctaatgggtcaactaaagtgaggactgagaagtattcaccaatttagcaatgtggagctcattggtgaccctcataagagctgtgttggtggaatggaggaggtaaaatcctggagggagagaacataagaatgagagaacagttgacagtgcatgtaaacaactctttcacggaactttgtatttctgaatttttgtttatttggctattaataaaatcatatctgatatagctttattttagtaaggtttgtttttgtgggacttcagttgtgtatacacatataatatgtgtgtgtatgtatgtgcgtatggtgttttgatgtaaaatttattattgtgggtcatggttaaaaaaaaagcttgagaatgaggagttagatcaagaaatagaaggaaagttgacataagaagttgtggatgtaggagattctaccatgtagacacagtggaaggatttagggagttggagcaggttgggatatgtgatcagaaagcgggagtttagctctctcacttgcccctgcttttaccatgtgatgtgtctgctaccccttcaccttccaccatgactgtaagcttcctgaggtctccctagaagccaagcagataccagcaccatgcttcctgtaaagcctgcagaaccatgagccaattaaacctctttgtaaattacccagtttgaggtatttctttatagcagtgcaagaatgccccaatacagaaaattggtaccgagaagttgggcattgctataaagatacctgaaaatgtggaaacagctttggaactgggtaatgagtagtggttggaagagtttacagggctcagaagaagacaggaaaatgagggtaagtttcaaactttttttttttttttttttttttttttttttgagacggagtcttgctctgtcgcccaggctggagtgcagtggcgtgatcttggctcactgcaacctctgcctcccgggttcaagtgattttctgcctcagcttcccaagcagctggggttacaggcatgcaccaccatgcctggctaatatttttgtatttttagtagggatggggtttcaccatgttggccaggctggtctcgaactcctgacctcaagtgattcacccacctcgacctcccaaagtgctaggtttacaggcgtgagccaccgctcccggcaagtttggaacttcttagagactagataagtggttgtgaccaaaatgctgatggtgatagggacagtgaagtccaggttgacaaggtctcaaaaggaaacgaatttattgggaactggagcaaaagtcacacgttatgccttagcaaataacttggctgcattctgcttgtgtcctagggatctgtggaagtttgaacttaaaaactatgacctagcgtatgtggcagaagaaatttctaagcagcaaagcattcaagatgtggccttctgctactaacagcctgtgctcagatgtgggggcaaatgaatgacttaaatttggaacttacatttaaacaggaagcagagcctaaaagttgggaaattttgcagcctagccaggtggtaaaaaaaaaaaccattttctccaaggaattcaagcaggctgtggagcaaccacttgctgatatttgcataactgaaagggatccaagtggtaatatccaagacaatggggaaaaggcctcaaaggcatttcagagacctatggggcagcccctcctgtcataggccctgaagccaaggaagactgaatattttcctgggctgagcccagggccctgttgccctgtgcagcctcagaacactgctccctgcatccagatggctccaactccagcaggggctcaaaggggcctaggtacagcttgggctgttactttggagggcataagccatagccttcacagcttccattaggtggtaagcctgcaggcacacagaatgcaaaaatggtgaattcttggtagcctctgcctggatttcagaggatgtatggaaaagcctgggtgtccaagcagaaccctgctgcaggagca

SEQ ID NO: 3 - DNA, 24970 bp, Homo sapiens
aggatgagagcttagagtcagctttgacttaaagaaaacaaacaaaagtgtgtatttttgcacatgaattgttgactgaggttcatgcccacacgatttgtttaacgtgtgacttttccaagtccctgacagccaagactgcctgaactcacggcccaacgccccaacgcatagtaagtgctcggtcaatatttcctgagtcgagtgaatgggtagttttggaagtcaaatcttggaagagcatttctctgtttcctccgggcagaccctgcaggcatcagctccaggaggcattcgtcctgacggtcccctaaaccctgctgacacatgagcagacactgcacaactgcactggcggtttctgtccagacaggcactccctctgtggtgagaaatacctctgaagttgcctagcatcttggggctccttgcccatctttagaattttcaagtgccccaagctattgtgaatgtgttcaatgtttatattccaagcagcttgaatctatgccttgcaaaaatgcaagttggaaagttaattcattcctttatgtcaaggtaattgcagtttcaccctaatcctctcttgtcaaagacatttctacaatgcagggagttatcttttacaagagacacttcaaggtgatttaataacaacacttgctatgagtcacattttccctgtagtcatctactcttcagcttgggagagcagggcttcaagtacagaagagagaaggcatttggctagtcacataacccacttacacacgctcagccaaatgtacaccttcaagagaaaaagaaagccctaatgagcacttgtggtaactaaggtgctaaacgagatctttccaagcaatgctatttttgtttgtttgctttagggcaagctatattcactcagtgctttgaaacttaagacacgtatgaatttcatgactgcggacaaagaggaaatttgatatggagattaattattaattcaacatttactgagcccctactatgagctgtgctaggggcttggctacaacagcacacaggcttgcctgccagctgccctcaccaagctagtggtccagcaggactgcagatgtcaaacaaataacaaaggccaaagatgtctctttctctctctgtctgtgtctcttttaaatgcaaaactataaatttattttatatactcctttttacttcatctgcatgataaaaggaatacagatgtattttttaatgtaaccaaattcccatctcactgcgcagtaggaaaaagtctacccactcctcacagtttctagttctcccctcacagtggagctcatcaaaaggcagaggacattggctgggacgtgaccaggtttcaggcaatttgggagtgaaaggccagcaggcagctttatcttgaagactgttcagctccacagggtgacagattctcccaccaaccatgtctctgtcagcctcagcccaagagaaaattgagctgaataagagaggtctcagtggaaattatattggaaagactcaccataatggcttcctgaaaaaaatacataaacaaaacacatttttccatccaaattaaacaagtaggtcaagagggcaactttgccaagtgccacttactcccacctccagctggaattttctgggcatgccagcactggtgttacttgccgtaggcagattctctacccatacttacaaaaatccacaccagctacttctgatggagttcttagcgtgcctctttcaactggatttctaaacaaggaacaatgtaattggcaggtaataacaggctaacaggattgtcttaacagatactggtgccttttcagttcagactttcaccagccaagaggttctatacaaaagatccacacatcagagccatgtgatgagaggccaaaacactggagagctgtaaccctgaatgaaggagtcaggtttacatattgattcaaaaaaaaattgctactcttatccctgtgtgacatcatgctttgaatatgatcattgaagatgttacttggagtgcagctaccttgaaccctcggtgaaatgaaatgggatagaaaggagtaagattgttgggggctttaactaccgttccacacttttgaaagttagaaaaacaaagagcaacagcagctgcctctgtgttggtaatcatattttccaccagcaactggctcccattggttggagccaatcctttgctgtaacagaggatctaagctgccaagagaaggtcctcatgttcagatagagcaatagagcggagcatttgaaatgaggagcttcacaccagtcccctgtaggtctgagtgcctgaggctccctgcaatgcgtgcacacagtcattatgctgctccacagaaagagatgggagctggatgagtccttccctgatgacttgtatgagctaatgatcctaccggaaatagaaaaaaaaaagaaaagaaaaaacactagtcatgtgatttcaagacagtgacaaaagcttaagctgaggttgccacaaaaggttgtgggaaggggtgtggtctataggcatgggtgcagccagggctgagaacgactagttagctgaaaacagctgcttttcttcaccaaaatatatgggtgaataatgcaccctgttttccagggggataatgcaaacaagtgctctgtcaaggtaatttttgtattccacagggatggcggggccatgtggggaaccacagctgtggagtggggatgtagtattgcttagagccaggtgtgtgggtcccaaagcagatgtcagtgcttaaaattagtaggaatgggagagccatgcctagatctttgctctgagatacagtcgtagtacccaaaaaagaagttccggtagtgggaaatgtagatttagagctgggctgtttgacgggaaggcagggaatggcttatgcaccagcagaaagccagtttccaccttgcatatccagtgaggttgccacagggccatgaccttcattcctggggtgccctgccctcagctcattgggtgtctgtgtggctagagtttggttctgtgtgaggagcaacttggaggggggaatggactttagctcaattcaaccaacatgactgtatattcactcggcatcaggtactgggatttcaaaaaactggacattgatgtagcacactgataatggagccaaaatctaaaccactctggaaaatccagggtgaccactgtacttaagtgccacaaatagctattttgcataatcaaagctttgggcttgaaggctttgttcatgcttttgctgctcactcatgacctttctcaggaattagtgctgccatatgttggagatttacctgtattagattttcacatgcatgagactcgatccttggcttcaactcagcaaatgtctatctctctagggcttcctatccaaatctttccagtctttcaaatgcctgtctgggagaagaagaattttggactttcaaaacaaaagctaagaaaggcctagtgagccccagtggtatgaacccatcctgtgctcattcgcattctactcagactttctgccatagcaatctgtttgttgtaacccaaccacacttctagcaaaaggtaacatttggggaccctgctctaacaaatttagagtaacccaattccatgttttctgcactgagcaacatgtacaactatcaccttgaaaattatgctggatctcagttactgagtcacatctgtccgagattagtagccccgagggctgggatgcttagtgctagtttcatattagaatcatctgagaagcttgaaaaagtgttggtacctggcaccccaccaccaaagattctaatttaattgttcttggttgggacaatgttttcttttaatctttgctaggcttcataatattactgctaatcagttttagagagtgagtgcttataaccaaactcccagcctggtttactacagcccctgtatttcctccttgatgccatttagcaatgacccatggacttttgatgactggacatctttagttctctggatggaaatctgaagatgaaggagaccttctgtgccaaatagaagcctgagatttttagtgaaactaacatacgtcatctggtcttcgtgaaacgattctgaggtttctaagaatttcccacaacactgaagattggtggcttagagtttattgacccccaaagaaaagggtatgtttgactgtgagatacagttgtccttgccattttcaagatattacccactgtctttgtattgaattaccttaaaagtattgactcatagaagcaacccacatggttaaacccaactttaatccaaaagtcttggtcatcaacaaggttttctccaactatagaaaaatgtgctccccaaatttgccacattctcattctctccatgtaacaaaaaagaaacaaactcttcattgtctggcccacttggatctttttatctcaaataattttttaaaaaatgcttatgttggcttggcttggtgactcatgcctgtaatcccagcactttgggagcccaaggcaggaggatcatttgagtccaggagtttgagaccatcccggggaacatggcaaaacattgtctctaaaaaaaaaaaaaaagccaggaatggtgatgcatagctacagtatcacctgagcctgggaagttgaggctgcagtgaaccaaatcgcaccactgtactctagcctgagtgatagagtgagaccatgtctcaaaaaaacaaacacacaacaacaaaaaatccaaaaaccagcttattttgagggttgggggaaataaatgacgaaggctagattcattttggactcaattctagctcctcagggaactttgaatgtatgccattcttgatatttatatttaatcccgactaggaaagagggaagtccaagattgctggatttttgtctctccatgccatttaggaatatctcaagactctttccactggagttgaaaaacaccaggtcctagttctgagttacttctgatactgaggtgttcctcctaggttttcagtacattttgtttacatctctacgtgtttcattgtcttatttttgttagctgggtttgtttcctgtctgcctcccatgaggtccttcagggctgaggctgaatcttttctcctaaatgcatccaatctgaacccaaagtcggtactcaaatgtgtgacaataaatgaagacacaaatgaatgatgtatcaactccccccaaagctagctgcaaggagcctagctgtaggacaagagggaaaggccgtggccacaagggagtaaccatgcgcggagcctggactacagagatttattgctaaggctcatgcttttgcctccatttgcccaccgttgttttgtcagtcaatgtctgtagttgttgaataacattcatttatacattatttagtaggtgtaatcaaagtccccatgatcacggccctgcttttaaaacttgcctcttatctgtaaacacatttcctgagctgctctatcttttcatcttgtctaggtgatctatagcaatatcccagaacctgcctattttctttttaattccctgatggattataaatagcctcttctaaacctccccaaagctttgacggcaaattcctgctttctaaattactatccacctcttgctccgcactcagaccccttcaggaggctgtcctccttccccagggcagacacaaaagccttctacacttccctggcgtcatgctaaaggaacactatggcaacgaccaatgtttggaacgattgcagccgaacacacacatcgctcactgcttcaaatgcttaatagcggtgattaaagaagagaaatctggcataaaagaatggcgggagaagaaagcaaatgagagagaacaatgagtgacaggagaaaaggaaggagtgaggagagacctgagggaaacctgggagaacagaaatgaagacaagaagggaaaagggaacaatggggaccagagtgcaccccggcctgctttctttgaccttaggccctgcacatttgctaaaacacccaagtctgtcaaaccaccactgaagcaaatgctgttagaagaggcaacgtggctggaaagaactcggtgctctgtgatgccccatggatcctttctattctgcagataagagagagaaaaagccccattgcctaacttcctggattgcagagaaactgctgggcacatggtggatccggggacccaccgttctcaagaacttgctgtaatgggcaccttggatgtacacttacgaaggattgtgtttccaagacacttcctcctccactcaaaatttgctcatacttgcaaacaggaatcatcttctacccaaacccccatgaccatctctcaggccagagttgagcagccaggttgcccttctctgagcttgactctttctgtgtattaattttcaatttcaagtcacaacgtaatccattaagaagcacttattctcagcaaacctcttgagcaggctctcatttgctatttctcagtataaactcattcctaccttccggttcagtgttgacactaaatttggcacagtggctcagcacccaccttcatccctgcatcaatctccagttggttttctcatgcctccacaccatcaaaatcagcctcggcttttctgaatctccatggggcttagcagatggggtggcacttcataaatccagtctatgcaaagctgttagcaaaaatgcacagagggcagcctctcggccttctgtgggtatgctctgagctgctccaaaggtatccttaaacatggtatcattttgagcctctaaactctaaatagctaagccttctctacaatttatgccccttggcatccctgaaagtgggtaaaccgcactggttttgagtgaacatcctttaaaaaaaactcaatttcttaggatccaagtctatatgattgaaggacacagaaatgtacaaacgtgttcccaaaggcttgatgctgtgtaattgtaggcccctcttccctggagttaatctttattgtgagtttaccatgttccaggcattgtgctgattttcaggcattatctcatttgatccacccccaaactccagaatgatctttaaaacagaaatcagatgatgatgcttctcagcacagaactctccagtggctgtctcacttggaggaaaagtaaagtcctactgtgggctgtcatgaggcccctgtgagctctctgatggtgttttctagagaatcacctttcagttctgcactctagctggtcttgcggttgccctcatttgtcaactaactcccctctctcccctatgcttgtcttttttactctcaaatgtcatcttctcagggagaagatggctgcccagtgtacattgtacctcatctcctccccacatcccattcgttgctcacattctcttcatttcacccccactgtcaacctgctacatatttgtttactgtctccaccaactagaaagtagctggagaaggacaggacttctgttcactttgaatccccaggacctacaagaatggtgttttcaataaaacattttttagtaaataaatgcattaaagtattcttcttatctccattttacagttgagaaacaggtttagggaggttaattaactaaggtcttagagccagtaagtacaactagtactatgggctcaccaaccgctattcccaagttcaaaatgtcttttttcgcaagttcaaaatgtctttttgggaaatatttttgccatgctcattcaattgggggtgatttgaccaaagtgggaagctgagatggaacaagatgaacaagaaatcaccgggaggctgggtctggaatctgctatgcacactcacactcctccagactcacttatcttgtagggtctcctcacgtcactcttgacatcgaccaaattcaatcctttattaaatatacaccatagcattaaagtgcaggacagataagatcatataaattttttgacattttgaggaacaatgtgacactgctattaatatttgtaagtatcttggaaccatttactagatgcaatgtttgtgtgagggaaaagattatataaaatgagacacatcaacctcaaatacactagtctgtaaactcctagagggtagctactgtgctatattctccctgattagcaccaagaatgatctattgtaggcattcgataaatgttattgaatggataaatatctttggaaatgaaattttagttttgtctgcaagagcagatttggatagtggcatcttttccaggccaggcaatgacacacagttgtatgaaaacaatgccagggcagggtcagttacatttgaaagaaagtcataatcccagtggaaagttttacagatgaaatatatagttgcatggaatatcctgttataagagagaaacctggacagaatctgccacctcagtgctgggagggaatatatgttgttgaaatgtggcctccaaacagccagtcaggaggtgggttgctctccagccattaaaaacatcccagaggccaggcacggtggctcatacccataatcctaacactttgggaggccgagttgggcagatcacttgaggtcaggagttcgagaccaagcctggccaacatggtgaaatcctgtatctacaaccccgtctgcactaaaaatacaaaacttagctaggcgtggtggtgggtgcctatagtcccaactactcaggagactgaggcaggagaattgcttgaaccagggaggcggaggttgtagtgagctgagatcacaccattgcactccagcctggtcaaaagaacaagaccctgtctcaaacaaaaacaaaaacaaacaaacaaaaaaaacccaaaaccaaaaacaaaaccatccctgagggaaagacaaatggccatgatttacaaccagaaagttgaattggtgaagccataaacaagcagtctaaaaaaatcccagctgagactttttctctatataatctcttcttcctgccccatcaggcctcagagctctgccatatttcccttcaggggaggagaaggaagccccactgaggaacaaaatttccacaagtacccctgcttccttgggtttgtccaagtgcctgggatatcaggaagtgccttcaggtatccagcacttttggttcaagaaacaatataattccttatccaaccaccaaactcctaaagggaggaaggccagccttcaaagtggacagccatccagatgacattctagattcctcctactgacctggcaacacagggaacctctacttgagtgagcgcaggacatcgtgactagcttccaataaatacaatatggcaaaagtgatgggatattatttccatgattaggttataaaagactattacttccatctttctagcagacttttttttttatttttgagacagagtctttctctgtcaccaggctggaatgcagtggcgcgatctcggctcactgcaacctctgcctcccaggttcaagtgattctcctgcctcagcctcctgagtagctggggctataggcgcgtgccaccacatccacccaatttttatatttttagtagaaacggggtttcaccatgttggccagggtggtctcgatttcttgacctcgtgatccgcccacctcggcctcccaaactactgggattacaggcgtgagccaccacgcctggccagcagactctcttactggctttaataaagcaatctggcagtttgggaagcccaggtggcaagaaactgagcgtgtccttcagccaactgccagcaaggaactggggccctcagtccaacagcccatgataaaactgaattctgccaacaatcactaagcgaacttggaaacaccatgccccagttgaaccagtaacttggtttcatccataggaaaggccctgagctgcaagatctagccaagccatatctagattacacagaaactgtgacataataaatatgtattgttttaagctgctgacttttgagggcaatttgttacacagcaatagataatccaatataataaaaatgtaatgaaaactcagtgagatacacatgcaaagattcttgttaaaagtgtgaagcttgggatcataggatacttacagtagatactctctggaggagaagtatggggtcctacttcacaatgcaaagctgttcatgctattccaacctccacccccactatagctgcccatttatccactaaatcaagcacgagttccttagtctagcaacaaggtctgacatcatgtggtctctgcctatttctccaattttatctcctgctttcctaccacttgcactccgcctttaagtcataccaaactacatgtagttgccccaaatgctgtatacttttctctttttccctactgttccctctgcctagaatgccttcctgtacaggttcagttacaagcatctttggtgctctgtagaactccattcaaatccttacactgtcctctcaactctcttataccacatgtccacctgtcttataacctttggtttctttgtctaatacctctctagctgtaagctctgtattgagcctcttcttcaacctgggatcctcagagctagtttgcagtctggcaaatcacttcagtcaacaactaacgaaagaataactgtgggatggacgtgccagaaggagaaacaattatttattggcttaactgtaatttataccatgctattgaaataataggcagtgtaaaggacctacattcaggaaggttagtagcatacaaaattaaaagccacatagaaggatgaaaaagcaaatctgccaaacagtaggcatgtttgtcacaatgaaggattacatttcatcctaagtttgccatcagacaagcaagaaaattccaaggaattatgaatttgcctacaccttccaattgggttcatcctcaaaattcctccattaagacaaaagaaaggcttccacatggtttgtgaaaattattcaggtttccatgctatatatcagttctactcaccttcctggtgtaccaaatcagttcaaagagaaagaggaggggattttaaaatgaatatcttatttttatgcccttcaggaaatctgccttcctccccatttgttaccaactaaaattgacaaactgacccagagttaaatcaacttagggatcactcaaggagtgaaaccaaccaccttttcataaagaaatgctcagagaagaaggtagcaattacactttatcagagaaaatgtctttcttacaaagtatagccatcaagtggagatgtttgatgatccttttaaaatatctttaaatcagaagtaacttagcatggatgcccttcattttgaagaaagagaaaatatttgatgatttgatgattcatcaaaaatttgtttctatgcaacaggcttattgttatgagggatttcaatgcaaaattaataatcagccttggaaaagaaatgccttgaatcctataaaactgagatgacttaaaaagttctattcctgctcagtcaacttactgaaaaccaccatcatctttgatcaacagaagggaatatatccaaaagctaagctaaaatctctctttctttaggtcataaatcaactctgcaatcaagactacggagagtccgtgccacgcagatggctttgagttttataaattggttaggtgtggggacatgatcaatagtttgatgatttgactaagtaaaatgtgctgaaaaaaaccacctgtagggaggactcagatgactctgcacaaacattcttgaacttgaaaatccaaactgttagtcatattgagactaacaaagttaatatatgccaccaaaggagaaggctatatcatctcagggaaacaatttttgactgtgcttagtatttaggaaataatgcattcattgaaaggtaaaactggcagtaggcttacgatggcaatgggcagtgccagcagtggctgtggcatcctggagcaggaagatttggtgcatttctagtgcagcataggccagagtgacgtttctgacatttgggatgctacagcactgatagaagtggatgataaagctgtggcttcatttaaacaggctctaaagaatgatgacatttgtgaaacctcagataaaccaaaaagcatgcctaatagaaaacctgctaagaagcataaaggccaaaaaaagaatactgtaactttcttgaagtagtggaaagttggggacaaatgtcctgccatttggtcagaagacagctgcatttactctgctaccattgcttcagttgatatgaagagagaaagctgtgttgtgatttacactggatatggaaatagagaggagcaaatctgtctgatctactttcttcaacctctgtagctaataatataggacagaatgctcaaaagaatgaaaatgaaagtcaagattcaatggatgaaagtgagaactccaggtcctggaaacaaaccatttagcatcaggtcagaagctactccatggaattctgagaccacgaaagccaggtcaggtctcaaattcagtagcccaccacccacaccaccctgcttcccctcatgcttgctgcctccatttccttctggaccaccaaaaattcccccaccacctcccacaggtctagattttcttgatgatgttaatgttttatgaagtatgctaatctcttggtacattaagtggctatcatactggctattatacagggctcaagcaaaattaaaaagagggagagtgctcacgttccaattaatgagtaaatatgccattattataaaagtgaatcttacttttgtaaaattttatggtttgtggaaagcaaatgtcttggaatatttttaaatttaaaatgttaaaaagttgaaaggttaatgtaaaacagtattaaagacattctgataccaaaactattagataaaaggttgagctacatccctactagaattctcatggtatcaaagtatcacctcaccaaaaacttactggttggttgtgtggaaaaaatatacttttacaataaagagttccgtaggctctgatgacattttacatcactagtagtcagaaaaaacagacatgttttctgacctgtgatgcggtatgacctacgcatactgcactggtacactctatgacctgtgaagtgctctggtcaaaaaactttaactgaaatttaatcaggcctttagatctaatttcctgtttgcaggagatgctagggatagagcaacaagttaaatgacaccactaaagaaacgatcagacagatccagaatatagaatgttatagaagataactggcctcattgcttcaaaatatcagtgttgccaaaaataaaaataaaaaaaggtggaacgggtaactcttccagattaaaagctacttaagagacatcataacctaatgcaatgtggaatctttgattaaacctaagggggctgagaaaatttgaatatggactagattttgaatactagaccattattgctaattttatgagctgtgagaaggatgttgtagtttataaaagaatgccttcatttgcatactgatttaagaatgaggtgttatagtgtcccttaaaatgttttaaaatggttttgcaaaatgcgcatgaagcatatatggcaaaatgttaatgaatctaactggtgtgtatatgggtgttcaatgtgctattttttcctattttctgtatgtttaaaagtatatatatatttttaaattaaaaaggcaacactgaaacaagaataaacagttttcttcttacgctagaattgctacaaatttgattatgtaaaagaaactttaaaaagttatacttggtgtgggtttgctgaatcaggacagaccaaagctttcagtgccaatagttgtctccctcagagaaaattcgattggtgcattcttctggtttactgttgtccagattgagttttatttgatttgactttttcttatctacagtgctttagaggacttcttcatctttttttattgataacttaccagacaacctaacaggcaactatatctactatccaggcagccatcaacacacagaaaggctgaggagaatcaatcagggaccaaaacattccatgccaccagcatataaccttgcccttcatacactcccaacccagcctcaggaatactggccacaagggaaaatcagccaaatgctggagctgagaatgcgggttagtttgctctaagtaagtaaaggcacagctttaagttctttgtagcactccactacacaatgtttcctacaactctctgataagaattacctgaagcatgtgtgttaagcctgcagctttctagggacagcccccagagtctgggtcagaaagcctggaatggagacagccctcagaaatctacatttgtgacaaggaaaacagaatcctgatagctaaaagtgccaaaagattgttgctaggatggcagcccccaaacatagctgcacgctagaatcaccaaaggaacgttcacaattcagtaggacttactgaataaggatccctggcagtgggaaccaggactttattttttacactcccaccttgactgcatattagaataatctggggagcatttgaagatgccagtatccaaggcctcatgcaaaacgactgactcagaacctctcaaagaggagtagtttgtaaaagctccttaggtgatgaaaccagaccacagctcagcatatggaaaacactgaattgagtgctttaagatgaagctgggattatcagcttttaatctttattctccaagccagagcagcaaaaaggaactatacatcgactttgggacccacttagctgggctggtgctccaggctgctcgctgtgcatagctttaagttgaaccattgattcaggtctctctaaaaagcctatgaaattcagatcaaattaaaaagtgtcccatctgtaatgggaataaggaggctgggagcccagaaatggtgttcagtctgtctgccagttaaggatttccatatagcttcaaagaagttctaaccacatgatgacattgttgctcaggagtgaagagattctactaccagcaaaatggaaaggaaatactctggacacagcagctatattttcacagggtcctcaggatagtggtcggcacatggtaggcactcagtaaatatctcacgaatgattcccattaccatggctaaaacatgagtcttttaagatgtcttactgtggatctgtctccaacttcggaagaaattgccaccacagtcatcatcatgaattatgttactatgaataactggaactagcagcaaattgctttaattttaatgtgggccaaataagttctgcttagatatttaaatagactttacttaaacattctgaaggatggagatttcaaagctggcacctccctacctgtgaggcataataatggttccccaaagatgactactttctactccctagaacctgtgaatatgttacagtacctggtaaatgagcaaagttaaggattttgagctagggaaatgttcctagattatctgtgtggtcccaagataattcaagtttcattagaagatgaaagaaagactgcatggtggctcatggcctgcaatcccaacactttggaaggccaaggcaggagaatggcttgaggccagaagttcaagaccagcttgggcaacatggcaagaccctatatctacaaaaaataaattagcggggtgtggtggtgcatgcttatagtcccagctactaggaaggctgaggtgggaggatcgcttgaacccaggaagtcgagactacagtgagctgtgatcacgccactgcattctagcctgggtgacagagcgagaccctgcctcaggggaaaaaaaaatgatggaagacagacacagttcagacagagagagtggaagaagctatgcttctagctttgaagatagaggaagggccatgagccaaggaatgcaggtggcctctagaagatgaaaaaggtagagaaatggattctcccccagaaaagacactggaagaaatgcagccttgttgacagtttgattttaacccagtgaaactcactttacacttctgacccctgaagttgtaagaaaataaatctgtgttattttaagccacaaagtttatggcaatttgttacaacaataggaaactaacacatcacacaatatttaagagaaaaaaataatttggagaataatagtgactacattagcatttctttgcatttcaacatagcaaagggctacatttgtatcctctataagatgatgtggctagccacatccctttcaaaactgtgatatggcttttaagagtataatggtgaaataaaggttactgagatgcttgctataaataaaatcacagactatacaataaaatgaccatttctatgtggtatatgtgccttaagaaaaagtgacatcattctaaggtcttgtacatggtaaataaatgagtagaacgtctggctaaccaagatcacaacttgggcttactccggtgaatgcccaacactctctagagaatggcttcccacgcaaataccactcaccaaaggtgtaaggcactgctgcataaagatgacagtgatgctcatactgcatacccacccttctccagaaggcactatacaaccatgtttgaaagggcgtgctctcacactgtccttcctatgatccagggcactattcatgacatgtttgtgtaggctcaggaagtgtgtagtcatgcaagggggcaaaccagtgggttgaaaaggggcttgaacctatgacctcagcttcaccagtgttacctctagcaattgagctcatcaggtggaaatgggttcaactctatcagtcctatgtggcccagctctgaggcaagagacctggctccctttcattccaatgggctgaaaacagctttgaaggagcagcagtcagttacatagctgatgactgccctgcaagaatgtgcacctgaggaagggcaatgatcacaataggctgaagacactcggggctgaatggcaaacagcaccagtgtaatcctacatattggcaaaattctccaccaactagagaatagagaattgtttcatcagactccaacagcatcatgactaccatttattaagcactttactgtggaccaggcacagtgtgctaagtgtgctacaaacatctaattttaacaatcaccttaaacagaggtccattgttcatctcatctcacaaatgagaaaaccaaagtgtgggaaagtatgttgttttaaggttatatggctaggagtgacagacctggcattcaaaaccaaatctttctgcctctaatgttatactacctttaatacagtagcagaataagacacacttttaaggaaagaggcagcagagaattggcatcaaggtagcaacttacttgcaagccaaggaagatatttatttacggccatttatttaatcggttcatcattttttgagcatttggtctacgctaggaattgtgcccatacgacttggaatcaccaaaatatcaaagggtatcaggtagtaggacttggagacacagtgaaaacctacaaagttccagaacatgctctaacagggagaggacctgccagctgagcaattccaccctggacatggcagcggcagccagaatgacttggcaggtgacaatgaagaggtagcatctcaaacaaaggtgtcaagtttgaggaaaacaaacacaacctcaacatgcaacaggctcaggaaatggggccagagaccccaaatatggaatgcgcccttcttccttgcaggactgatgttcaataccggcctattcacctgttcaactgataggctaacacaagggcgggggtgaggaaggaagggctggcttggagaccacatcacctgcaaagcctcttcagcaacactgacaacgccctttaaaccctggatcctgtgggcctacccttaatatgagggagatgctcaattgttaccacaaagcagcagctgtcaaggttcagaacacaatatcccaaaatatggcaccttggcatactgagtattttaaactgaaggaaactgacaaaactcagaagcagaaagagcactctttttgccacatttctcccatgaagattggtcatttaaaaatttttctgtgctgggcgtggtggctcatgcttgtaatcccagcactttgggaggccgaggcaggtggatcacctgaggtcaggagttcaacaccagcctggccaacatggtgaaacctcgtctctactaaaaatacaaaaagttagccgggcgtggtggcagacgcctgtaatcccagctattcaggaggttgaggcaggagaatcacttgaatccgggaggcggaggttgcagtgagccaagatcaggccactgcactccagcctggtcaacaaggcgagagtccttctaaaaaatttctgacttacctcacctgaaaggaggtcaaaaagatcctcattccaaaggagtcctgccctataccctgaggtcagaagaatctgaacaatcaggccttgctaagtgcccccagtttattaccattaggtcataccgcctttatggatacttccgtacgactgtccattcttcatcaaagttaagcataaaaatggagcttcctctgggtctcttggaccttcatttctaatggctcccatgtcacacaaaactttggttgaatctgctctgcttctctcttgttaatctatttttaatgtaggggtgtcagccatgaaccttgcaatgggtgaagaaagatattttttctaccctacacagcccaaccaaaccatatgcatcataagtgcatatgataaaagtgatggaaagagaaatctgaaggtatactttcagttccacatgtcccaaagtgttttcctcgaaactacagtgaccacatgccctgatttgccaaagacagctttgatttattcatgttgtcctgggatgattattaatagtgtcccatttccttctcaaaaatgttccagtttgccagatctagtggtatggacctgtagtcccaactacttctgagaccaaagcgggaggttcacttaagcctaggagttcaagaccatagcatgttattatgtgcctgtgaatagctactgcactacagccctggcaacgtagagaaatcctgtatgtaaaaaaaaaaaaaaaaaaaaaaaaaaaattccagtttggccaaaaagttacatggttagctaatccagaaaaccacttctagagatagtaatagccgtgttgtccttctctgaaactgtgctacccaaactatgttataaaccttgaagaatgaaatacagtttaaaaacgattttgaggctgggcgcggtggctcaggcctgtaatttcagcactttgggaggcagaggcaggcggatcacaaggtcaggagatcaagaccatcctggctaacacggtgaaaccccgtctgtactaaaaatacaacaaaaaattagccaggcgtggtggcgggcacctgtagtcccagctacttgggaggctgaggcaggagaatggcgtgaacacggcaggtggtacttgcagtgagccgagatcgcgccactgcactccagcctgggtgactgagccagactccgtctcataaaaaaacaataaaataaaataaaaactattttgataaagaaacattattttaaatgccaaacagctattattatcttgcataactactattgtgttacatactgtttgggaaatattgcattaaataaagttaaacaagtttgactattggtggaacatgtggctttccaagatttaatattttagtacgtcatgaattgccaagagggtcatatactgggcaatttttccaaacttaaacgcaaaaccatttctcatgaaatgtcaaaagaggttcatgttccacaaaatgctcccacattttcatttgataaatagaggtgtctcgtatgtcttggacttgttctaggtcctggaatcagcagtgaacaaaccaaacttcttgccctcaggtgcttctgttctagtgggggagacagataataaacatggaaacaaataagtattgtaatttggaaaacaatgatttatcccccaactgattcaaagtcaaaactcccgacatctaacaattctgagggatattcatgaagcagcctgtcttcagatgtgagttggcaatgatttgtgtctctcaaaagccatcgtcgggcatcgtgtttcctgaataaaagaagcttcccttaagaagtctccgcctttgaactaagcgcgcttcatttggcattctcattagtatagatgtgcttttgggggagtccacctttatttagattgcttgtggaccgtattcgtgtgtacctttaatttaatgctatttcctgtcctagctagaccgaggtgttatttaaaacagcgtccctttcaaaagagatgttaataggtgcttagcacccagggaatacattccaacaaatgaagagttatacattctatgccacacatcccatcccctagggctggggtggcgagagacaagaaggttcatacacacacacagacacacacacacacacacacacacacacacacacacacacacacacactcctaccctctgattggttctgtgcagaatagagactcacatttaaatgaataagccaagttaaaactttccatcctggaacaaagcaaaaggaaagcctctttatgttgcagggactatagatgccacgggctgagcctgtcccaaagcttccctccactgctcaaaaactaagccatcttgctgcgtttagcacttctcaccagaccacccacccagacacggatacacaaaccacatgtgtgaggaatgctgttcggctaggaaatcagtatcagtatttcaaccttgttacttgcacagacggcccttttagtgcgactcatttgttttatcttttcaatagctttgattattttcttttaatggcctggatttatccttttctacccttttgaagcctcagaactctgtggtggggactgcatggggtgggagacatgactacatgattaaggggaaaatgagcaaataacgttgtctttactcaccatctatctcccactccttgtgggcacctcccattccatgcggactgccgagtgccctagtagtcaccctgaattgttataaaagtggactcaaggagccttctcattcaggtcgaagactatttgtgctgttatttaagagccatagggcccagttatcattatcagagtgttttctggtttgtgccgtatatttctctcactagctcctagggaccacattggttacccttctttaattaaggggaaattaagaccaagaggctaagctgagagccaaaggcaatttaacaacctctggaaaaaattggaaacgcctctacagaaggggaccgcataaacaggaaggtatggatactattacctggcagagaaagcagaagctttgaaatgtgctccgtgttttctatttgggtggtatccctggcaaggaaaccaataaaatacccttagttgttctactaatcagaataaaacaagaccactagttttggagacttatttccctgaattagcaaccagagaggtctgggggtcaggcttggttatctgtcatctctctccaggtttccttgcatatcgaaatggggccataaattggagagacaggaaacaaattattggggaaaaccatgtggtgcagtgcacccctgggtgagtgtgcttcagcagggcctggggctgatcttgaccctttctatacagtggagaaggtgtaaggccattattttaaataaaattgagtatctatgccacaacaagggaacagattagtccaatccaagtatggtcattagaaagttctactgccaccccaacccatctgggactgatgcttccacacctaaactcagtttcgggttgataagagacaaagcagtcccctctaatcccctaaatggcttgtcagcctgaatgaagataaagtcagtttctcaaatttgatgtaaatctccttactattaagtaagagcatcacatccaattccttggttatttaccaaactgaatgtattttattctctttgttgtagtagttgttctccttcctgtctaatcaaggtagcagttcttgctgtgaaagtaaatgcagggactttgtaagatcgactctctctggctatagcacattgtttctgaacaaaaccctccaaagaaataggggggaaagaaaaaataccgggcacacatagcccagtttatgccaaaaaatgtatcccaccacttcttgttccaatctttgcagagttttaaaaatattatatatatactggctttaggacacagaagatggtgttagacatgagggactcctaaaatgaatgaggcatggactctctgccttcagctggttttggacacattgtcctctctctggatgtctcagatctccccatctattcttctttagaaacagcatcacttcttgagaaaaggctaggggctaatttttcctgtatgcaaaataaagccaaactttggtcaaatgactctcagcaaatcagtacaattatacattttaaaaaaggtgctgaaacagattatatgagtttaagtaaaacacctatttctatcaatctgtacttacatttcaacatggattttagagaagggaaatacatcttacagtgtgccttgaattcacacaaaagcatgtacacatacacaatgtatctttcaacataactacacatacacagtccattaaaaagatactgacagatttataaaatgtattggccttgcactgttaatctcaataatacattttcacttaatttatttttgcactgcatggtagctctggccaccattaaggatctgtcagcatttccatcataactctattttcagaatactggagtacaagtgccaaaatacacatttacagtttacagacagcggtggctttgtcttccttttaaattgacttcttcactgcatctttacaaggaatattcagggatggcagtgcctacataataaaaagcatcatataaaacaaaagaggtcaaaagatgtagacttccagcccgagactaaactaaaccatgggaattgactccttaacattcactgcagctgtagtagtctctacatcatattcatagttttagagcaacagtccaaagcaagattactctgataatatatatgtgtatatatatatatatatgtatatataaatataggagcagtacatagcattagtacacaaaacgctaaaggtggaaagtaataagcatacagcaaattactccagagcagatcacttctacagtgacaaaaataaacacgagccaccaaacagacactgactgtttccaacactggacatccaactccattaagtaggcaaagttaaaacatttaagagtaaagtctctcttaaacaaatatattaactacatttgtggagcttgaagtagtaaataggatgttatacaggcctaaaattgtttcttctcttttttttaaagattaggtgggcctgtaaaagatatcggcaaaaaaaaaaaaaaaaaaaaaaaaaaaaaaattttgaagaaactttttagtggaagaaaaccaatattactggctctttccaccaaaaggtgaatattcagattagagagatttaaattgcctagcaatttaaaatgtttaagacactctcttaagagatatttttttcctgatctgaagtttttatagtcttccctaccttgacactatatgaacgcatttatagacatacctatttgtctgtattaagattgagagagaggcagattatgctgaggatggtgaagtaactgcaaaatattgttgctaacatgactgttacatccgaagacagaaggaaccccaaacccaccaacacacatcctgctgcaaaaccagaggcaaaagctaagttataagggggcagaggggcaggagctctgtacatatattttttcccctggctgatcactgaggaaaaattttttaaaagtttatcatactctggctggttcaaaccatattcacatttacccaattaattttatttgaaacatctatttatatatgtacaccaaagaaattaaaccctgccattttccctttgtgcttaagaaaccagagccactgttagggtactcacatgtcaaagatattcttaataggcttcaaagttgggtgtatataaatgtgacagaactgaaggggttactttaagagaggtattaaaactacttgaaattaattcaaagggatctttttatttctgtatttaaaaattagatgagagcaagattaccacttcaaaaaaaataacgtaactctcagtcttaattttgtgaaaaacttactttgctatcttgatgagtagaagatggataagtttttctgaactttatcaatttacaaacttacattttaggatattctgaagaaattaactttattacctaattttcaagtctaaagtttatcatataatagctgtccttcttatcattatttttgtttggtcatttcttatcttacctagcttcttggttagtaacttaaaggaaaaaatttttacattggcaaatcatattttttgccccacaatttagttacagaaataaaaatggcccaaactacatatatacgtttctagttaaactacacagatatattaaatcacataaacttctggcttgatcagaatatgtgttagcagttaga

SEQ ID NO: 4 - DNA, 52071 bp, Homo sapiens
caggcttttccatacatcctctgaaatccaggcagaggctaccaagaattcaccatttttgcattctgtgtgcctgcaggcttaccacctaatggaagctgtgaaggctatggcttatgccctccaaagtaacagcccaagctgtacctaggcccctttgagcccctgctggagttggagccatctggatgcagggagcagtgttctgaggctgcacagggcaacagggccctgggctcagcccaggaaaatattcagtcttccttggcttcagggcctatgacaggaggggctgccccataggtctctgaaatgcctttgaggccttttccccattgtcttggatattaccacttggatccctttcagttatgcaaatatcagcaagtggttgctccacagcctgcttgaattccttggagaaaatggtttttttttttaccacctggctaggctgcaaaatttcccaacttttaggctctgcttcctgtttaaatgtaagttccaaatttaagtcattcatttgcccccacatctgagcacaggctgttagtagcagaaggccacatcttgaatgctttgctgcttagaaatttcttctgccacatacgctaggtcatagtttttaagttcaaacttccacagatccctaggacacaagcagaatgcagccaagttatttgctaaggcataacgtgtgacttttgctccagttcccaataaattcgtttccttttgagaccttgtcaacctggacttcactgtccctatcaccatcagcattttggtcacaaccacttatctagtctctaagaagttccaaacttgccgggagcggtggctcacgcctgtaaacctagcactttgggaggtcgaggtgggtgaatcacttgaggtcaggagttcgagaccagcctggccaacatggtgaaaccccatccttactaaaaatacaaaaatattagccaggcatggtggtgcatgcctgtaaccccagctgcttgggaagctgaggcagaaaatcacttgaacccgggaggcagaggttgcagtgagccaagatcacgccactgcactccagcctgggcgacagagcaagactccgtctcaaaaaaaaaaaaaaaaaaaaaaaagtttgaaacttaccctcattttcctgtcttcttctgagccctgtaaactcttccaaccactactcattacccagttccaaagctgtttccacattttcaggtatctttatagcaatgcccaacttctcggtaccaattttctgtattggggcattcttgcactgctataaagaaatacctcaaactgggtaatttacaaagaggtttaattggctcatggttctgcaggctttacaggaagcatggtgctggcatctgcttggcttctagggagacctcaggaagcttacagtcatggtggaaggtgaaggggtagcagacacatcacatggtaaaagcaggggcaagtgagagagctaaactcccgctttctgatcacatatcccaacctgctccaactccctaaatccttccactgtgtctacatggtagaatctcctacatccacaacttcttatgtcaactttccttctatttcttgatctaactcctcattctcaagctttttttttaaccatgacccacaataataaattttacatcaaaacaccatacgcacatacatacacacacatattatatgtgtatacacaactgaagtcccacaaaaacaaaccttactaaaataaagctatatcagatatgattttattaatagccaaataaacaaaaattcagaaatacaaagttccgtgaaagagttgtttacatgcactgtcaactgttctctcattcttatgttctctccctccaggattttacctcctccattccaccaacacagctcttatgagggtcaccaatgagctccacattgctaaattggtgaatacttctcagtcctcactttagttgacccattagcagcatgtgacctattggctttcacatggcccatcacccctcttcctcaaaacactgccttcatttggcttccagggcatccctcttgattttcctaactcaatgagagctcctccttagtctcctgcactgtttttcctcatatcctatctctaaccactgagagaaccccaaagttctcctctgacatcttctctatttgaatgcacttcctcagctatctcctctagttcaacagctttaaatttactaacttctacatttccatctctagcccagacctctcctctgaactatttttttattttataatatagacggggtctcactttgttgcccagtctggtcttgaactcctgggctcacatgattctcctgccttggcctcccaaagtgctgagattacaggcatgaggcattgcacctggcctggactctttattcacatccaacttctactaatgggcatctcaattttcacatgttcaaaacccaatttctttcctgccacaaaagtactccttatgcagacctccatctcattaaattctaactttatttttccagttgcataagccaaaaatctcggagttacacttgacactcctctttcatacaccacatgtaatcaatctactgaaaaatcctggtggctccacttggaaaatatactcagatccaaccaccactacccacactggctctaactagtcagcctgtttcctcccttcaaacctatggtgtattttcaacacagcaatcagaagtctctttctgtaagtcagatcatgctataccttgggttcaaaacctttccatggactcccagcttaaaaaagtaaatgctgaagaccttactatcgctgacatatggcctggcccttgactacctctcttagctccatctccttaatctctcctccttacttccactccagccacgattaactccttgttgttccccaaacatgttaaatacacttgtgtcttagggcctttctatttgttatctcccttgcctgggatactctccctctagttgtacctagaacagttgaatcatcgcataattgctaaaaggacaagtgaccatgtgacaacgttctttcatcttttatgcttgtaacaccagaatttacttgaaaaagtttgtaagtggacaagtatgaaagacagatatgtacacaaagtaacaggaaggtaaagatgatgtgaaaaatgaaaaccaatccactgaaagtcattctaattggtatttataaatgtaaaaacaaaaatgttttgctgttatgtaacaaagaatatagccatcatctatcacttcaacaaaactatgagccctaaagttttcagaagtattgcagtttggacaggtgtggtggctcatgcctaccgtccccagcactttggaaggcaggaagatcacttgaggccaggtgttcaaggccagcctgggcaacacagtgagaccctatttctacaaaaaataaaaataaattaaaaaacaaaaagtattgcattttgacaaagtgagttcatgaagaatacaaataataaggtagaacatagtagagatgcatttgaaatccaaaatccgtatttaaaggtaggtatgttccagattcatgcataatgacagctgctttcaaaggatgtaatgccttttaggtatacataaacattcaaaactgggaaaatatgggaaaaaatgtgggtctcctatatttggattctcattaaaattgctaacaaagttaattttcaccatccctttattcttctgtaaattgtttataaaatgacttgaaaaagaatgcagtcaattctcattacttgaggtagttatgttctatgaagttgccacaaacacgcaaattagtgaatactgagccattgctcctaacagaaatacagggttaggttcttgtaagcctttggtcacattttcaccaacttataaatacgtaagcttgttttatatctgtttctgtttaaagacacattatttaataaatatagacctggcatggtggctcatatctgtaatcccagcactctgggatgccaaggtgggtggatcacttgaggtcaggagttcaagactggcctacccaacatggtaaaaccccacctctactaaaaatacaaaaattatgctgggtgcagtggcgggtgcctataatcccagctactgagaagactgaggcaggagaatcgtttgaacccgggaggaggaggttgcagtgagccgagattatgccattgcactccagcctgggtgacagagtgagactccatctcaaaaaatataataataaatagtgatgactcatcatcatctaactcccactcaacagcactataactcatgactaaacaaaggttatctaacacatgtattctctaaggcacctcacagcccgcatgcaccttggaataccactatatagcacttcagcacaatgcttgggaatcactttaaacagtaaaatcacaaacagaaggcacaaaaatgtgaaaaatgtagaactatataaactgctttcgaaaaggacacttgtttataataagaaagctacacaaaaaactgagcactgttcaaccccagctgggaatatctggataaggttctcaaatttttcacctctgtgtatgtccatgaaaaaccatgaaactgccatgagtattgatgttaggttacaaataaattttagcaagtaggtgcctttacaaatacagattctacaaataaagagaattgactgtaaataaaattttataagcaaaaactctgaaaataaaaacaaatagttaaaatggtaatgggaagacgatataaacaacagaaaattaaaagttcttaaacacatgaaaaggtgctgaacttcacaataaaataaaaatgtacaaatatgagataatcatttttaactattcaattgacaaagattcaaaggtttgataaattattggctattttgcaggaaacaaactctccatgttggtataaatatagattaatataacctctactgaaaacaatttagcaaacttttatttacaatttaaatgtaggtcgggcacggtggctcatgcctgtaatcccagcactttgggaggccaaggcgagcagatcacaaggtcaggagttcaagatcagcctggccaacatggtgaaaccccgtctctactaaaaaaatacaaaaattagccgggcatggtggcgtgtgcctgtaatcctagctactcaggaggctgaggcaggagcactgcttgaacctgggaggcggaggttgcggtgagctgagatcacgccattgcactccagcctgggcaacagagcaagactccgtatcaaaaaaaaaaaaaaaacaatttaaatgcaatagcctcttcaacacagtagttctaattctagatacttaatcctaaagatgctgactgtactattaaataacaaatgattagaaacaaattaaactctcatccacaagagctcaattcattaagcgtggtacacatctgtaagaatatcctgtaagtgcttaaaagaatgagagcttttttttaaatttttaatttttgcatttttcttattttattttattattatactttaagttttagggtacatgtgcacaatgtgcaggttagttacatatgtatacatgtgccatgctggtgtgctgcacccattaactcgtcatttagcattagatatatctcctaatgctatccctccccattccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcatttcttatggttgcacagtattccatggtgtatatgtgccatattttcttaatccagtctatcattgttggacatttgggttcgttccaagtctttgctattgtgaatagtgccgcaataaacatacgtgtgcatgtgtcttcatagcagcatgatttatagtcctttgggtatatacccagtaatgggatggctgggtcaaatggtatttctagttctagatccctgaggaatcaccacactgacttccacaatggttgaaccagtttacagaactctccaccccacatcaacagaatatacatttttttcagcaccacaccacacctattccaaaattgaccacatagttggaagtaaagctctcctcagcaaacgtaaaagaacagaaattataacaaactgtctctcagaccacagtgcaatcaaactagaactcaggaataagaaactcactcaaaaccactcaactacatggaaactgaacaacctgctcctgaatgactactgggtacataacgaaatgaaggcagaaataaagatgttctttgaaaccaacgagaacaaagacacaacataccagaatttctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagagctgaaggaaatagagacacaaaaaacccttcaaaaaattaatccaggagctggtttttggaaaggatcaacaaaattgatagaccgctagcaagactaataaagaagaaaagagagaagaatcaaatagacgcaataaaaaatgataaaggggatatcaccaccgatcccacagaaatacaaactaccatcagagaatactataaacacttctacgcaaataaactagaaaatctagaagaaatggataaattcctcgacacatacaccctcccaagactaaaccaggaagaagttgaatctctaaatggaccaataacaggctctgaaattgtggcaataatcaatagcttaccaaccaaaaagagtccaggaccagatggattcacagccgaattctaccagaggtacaaggaggaactggtaccattccttctgaaattattccaatcaatagaaaaagagggaatcctccctaactcattttatgaggccagcatcatcctgataccaaagccaggcagagacacaaccaaaaaagagaattttagactaatatccttgatgaacattgatgcaaaaatcatcaataaaatactggcaaaccgaatccagcagcacatcaaaaagcttatccagcatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaattcaacaatccttcatgctaaaaactctcaataaatgaggtattgatgggacgtatctcaaaataataagagctatctatgacaaacccacagccaatatcatactgaatgggcaaaaactggaagcattccctttgaaaacacgcacaagacagggatgccctctctcaccactcctattcaacatagtgttggaagttctggccagggcaattaggcaggagaaagaaataacgggtattcaattaggaaaagaggaagccaaattgtccctgtttgcagattacatgattgtatatctagaaaaccccattgtctcagcccaaaatctccttaagctgataagcaacttcagcaaagtctcaggatacaaaatcaatgtacaaaaatcacaagcattcttatacagcaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaaaagcccgcatcgccaagtcaatcctaagccaaaagaacaaagctggaggcatcacgctacctgacttcaaactatactacaaggctacagtgaccaaaacagcatggtactggtaccaaaacagagatatagaccaatggaacagaacagagctctcagaaataacgccgcatatctacaactatctgatctttgacaaacctgagaaaaacaagcaatggggaaaggattccctatttaataaatggtgctgggaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaacggcaacaaaagccaaaactgggatctaattaaactaaagagcttctgcacagcaaaagaaactaccatcagagtgaacaggcaacctacaaaatgggagaaaatttttgcaatctactcatctgacaaagggctaatatccagaatctacaacgaactcaaacaaatttacaagaaaaaaacagacaaccccatcaaaaagtgggcgaaggacatgaacagacacttctcaaaagaagacatttatgcagctaaaaaacacatgaaaaaatgctcaccatcactggccatcagagaaatgcaaatcaaaaccacaataagataccatctcacaccagttagaatggcaatcattaaaaagtcaggaaacaacgggtgctggagaggatgtggagaaataggaagaatgagagttttaaatactgatatggtgtgttctccaagatatattgacagaaaagcacttatctattgaagaacattatatgaattacctctaaagataaaaaattttaaaagttcaaaaagggtaatgatgatatatcatgacagaacttaattactttttttctttttgagacagtcactgagtcacccaggctggagtgtagtggcatgatcttggctcactgcaacctccgcctcctgggttcaagtgattctcatgcttcagcctctccagtagctgggattacaggcgcccaccaccatgccgagctaattttttttttgtatttttagtagagatggggtttcaccatgttgggccaggctggtctcgaactaccgacctcaggtgatccacccacctcagcctctcaaagtgctaggattacaggtatgagccaccatgcctggccttaattacatgttttttaaaaattcacaataaatgtatacacaaacattttaaaaaacacaaaagggtacactgtgaaaagtgtacagaagggctgggcatggtgattcatgcctgtaatcctagcactttgggagcccgaggtgggagaatggcttgaacccaggaactcgagaccagcttgggcaacatagatcatgtcactaccaaaaaaaaaaaaaagtgtacagaagcagagttgctcttgttttttgtttgttgctttggtttggtttttttttttgagacagggtctcagtctgttgcccaggctgaagtgcaatggtgtgaacatggctcattatacagcctcaacctcctgtactcaagtgatccttttgcctcagcctctccagtagctgggactacaggcatgcaccaccatgccttgctaattctttcattttttgtagagtcaggggttttgcgttgttgcttatgctggtcttgaactcctgggctcaagtgatccgcctgtctcgtcctcccaaaatgctgggattacaggtgtaagccaccgtgcctggcccagagttgctcttagtaacgtgttttgttttttttttttttttttttttttttttttttttttttttttttttttttgagacggagtctcgctttttagcccaggcttgagtacagtggcacaatctcggctcaccacaacctccacctcccgggttcaagcaattctcctgcctcagcctcccaagtagctgggactacaggcgcgtgccaccatgccgggctaatttttgtatttttagtagagacagggttttactatgttggccaggctggtctggaactcctgatctcaggtgatccacccgcctcggcctcccaaagtgctgggattacaggtgtgagctgccgcgcccagctgctcttagtaacttctggaatttgatgtctaaattgaatccattatttcaaacatcacaagacttaagttcataaaaacttttttaaaaagttaactctgggtcaggcgtagtggctcaagcttgtaatcccagcactttgggaggccgaggcaggtggattacctggggtcaggagttccagaccagcctggccaacgtggcgaaaccacgtctctactactaaaaatacaaaaattagccaggcatagtggcacatgcctgtagtcccagctgctcgggaggctgaggcaggagaattgcttgaacctgggaggcagaggttgcagtgagctgaaattgcgccactgcactccagcttgggtgagagttagactgtatcaaaaacaaaaagaaattaactctgtagtttatttctgttaatggcaaccctgcagaaaagttaaacttagaatatgtctcaaagtaatctctgtctgatcccttaatgaaggatctcttcaaacacagcaacttttgtctgtcttctgaatgtaggtacagctgtggctgtagaacagaccatgtaattttcatctagattccttacaaccacaaggacaattattacaatgaaagccagagaactagctcagttttgattttattactaggataaatccagccaggtagtgtggtggctttgatgttttctgtctatatctaagggggaagctgcttcattattcgatattaagataaatagggcctaaaaatagtcctaggtcaaacaccattatgattaactcaactttcaaaaccatttacctaatgtaggatttgttaataagtcttcttcaaaattagcaagaaatacaactaatgcctaacccgtcatgatgaattaaagactgatccaaaaataactgacagttctcttccagttgccctcttctttgacaatcccaccagtctatgctctaagctcacgcttgacttccaaaaactgccagatattgtagacaccatgaagaataagatgtactaccttttctctaatgaaagaggaaatacagatataaacaatatataaacataatataatgtgaaaagctatgtatagaaataaatagagaggccgtgtgcggtggctcacggctgtaatcccagcactttgggaggccagggtggtcgaatcacttgagggcaggagtttgagaccagcctggccaacatggtgaaactccatctctactaaaaatacaaaacttagtggggcatggtgccacatgcctgtaatcccaactactcacgtggctgaggcacgagaaccgcttgaacccggatagcacaggttgcagtgagctgagattgcaccactgcactccagcgtgggcagcagagcgagactctgtctcaaaaacaaacaaaaataagaatatgtaaagacatgaaaaatgtgacattaagtgggaatacacatgcacatacacaaaatgctatggtggcatccatatcaaaatatgggccaaagggcaaaataatatgcaaaaaagaaatacaatcacagatacagctaatttaaaaaaaaattaaatatttttattatatacttttaaacatatagaagatagaaaaaaacagtacaatgaacagccatgtccaccagttagattctgtaacattttgccacatacgcctcacatacattttgttaaaccatttgaaacattttaagacactctaacacttcattcctaaatgcttaagtatgcaaattaagacagtcttttataaactacaacacccttctcacagctcataaaattaccaataattatccaatatcattcaaaatctaatccacattcaaattttctcaactgcctcaccaccgtgctggcctcccacccccaccccagtcttttacagatggtttttcaaaatagagtccagtaaaatatttcacattgcatttggttattacataacttttaatcaagaagagttacccattccacttccttttttctttcccaacacttgatattttgaagaaatgaggccagttatcttctataacgcttcacattccagatctgtctgatcgtttctttagtggtgtcatttagtgctgctctatgccagcatttcctgcaaatgagaaattagaaccagaggcttgacgaattccagttaaaccatgtcctctgtggacaccagttaaacttgactagagcacttcatatgtcagagtgtacagtgcagtatgcctaggttatcccatatcacaataaaaaaaagtctgctggtctgcctactagtgatataaaatggcatcatatcctaaagctctttattgtgaaagtatgtttcttccacataaccaaccagttaagtatgagaattctagtagggatgtagattaaccttttatctaatagttttggcatcaaaattctttaatattgattgttttacattaacctttcaactttttaacatctgaactttttaaatgttcaaaaacatttgttttccacaaaccataaagttttacaaaagtaagattcactttcataatgctggcagacttactccttaatttaaggaatgtgagcaccttccttctttttgattttgtctgaaaccctgtaaggaaaataaaggaagttaaaaaaaatagctatatagacatagatagctatatatagatagctttatatggatgttaaaaagcattttgtttcacaagacattttacttattttattcaacaaaatatgatcagaaattaagttgatagtcttttaatgtactttaaaagttatcccaaagaaaacaattattaggctgcagttaaggttttcttgcagtggctcatgcctacaatcccacaactttgggaggcggaggtagggggatcacttgagacctggagcttgacaccaccctgggcaacataatgagaccctgtctctacaaaaaatttaaaaattaggccggcgtggtggctcaggctaggcacagtggctcacgcctgtaatcccagcactttgggaggccgagacagttggatcacctgagctcaggagttcgagaacagcctggccaacatggcaaaaccccatttctactgaaagtacaaaaaattagccaggcatggtggtggggacctctaatcccagctacttgggaggctgaggcaggagaatcacttgaacccaggaggcggaggctgcagtgagctgagatttacaccactgcactccagcctgggtgacagagcaagactctgtctcaaaaaaaaataaataaataaaaataaaaattagccaggtgcagtggcattatcactgtagtcccagctactcgggaaactgaggtgagaggactgcttgagccctggaggtcaaggctgcagtgagctgtgaatgtgcccttgcactccagcctgagcaatagagtgagacctggtctctaaaaaataaaatttaaatttaaaaaatttaaaaacattgccggtcacagtggctcatgcctgtaatgccttgcacttttggaggccaaggcgggcggatcacctgaggtcggatttggagaacagcctgaccaacatggagaaaccccgactctactaaaaatacaagactaggccgggcacagtggctcacgcctataatcccagcacttggggaggctgaggcgggtggatcaaaaggtcaggagatcgagaccatcctggctaacacagtgaaaccccatctctactaaaaacacaaaaaaattagccgggtgtggtggcgggcacctgtagtcccagctactcgggaggctgaggcaagagaatggtgtgaacctgggaggcagagcttgcagtgagccaagatcgcgccgctgcactccagcttgggggacagagcaagacaccctctcaaaaaaaaaaaacaaaaaacaaaacaaaacacaaaactggctgggcgtggtggcatatggctgtaatcacagctactcgggaagctgaggcaggagaatcacttgaacccaggaggcggaggttgcagtgagccgagattgcaccattgcaccccagcctgggcgacagggcaaaactccatcttaaaaaataaataaactaattaatttaaaaaaatatttttcttccttttttttttgagacggagtttcgctcttgttgcccaggctggagtgcaatggtgcaatcttggctcaccgcaacctccgccttctcagttcaagcaactctcctgcctcagcctcccaagtagctgggattacaggcatgcgccaccatgcccggctagttttgtatttttagtagagacagggtttctccatgttggtcaggctgatctggaactcccgacttcaggtgattcacccgccttggcctcccaaagtgttgggattaccggcgtgagccactgcgcccagctgatttttcttctttcagtatgtccaatgatgttcctgagcccgcttataccttatttttttttttttgagatggagttttgctcttattgcccaggctggagtgcaatgaggtgatctcggctcaccgcaacctccacctcccaggttcaagcaattctcctgcctcagcctcctgagtagctgggattacaggcatgcaccaccacgcccgcctaattttgtattttttttagtagagacggggtttctccatgttgaggctagtctctaactcccgacctcaggtgatccgcctgcctcggcctcccaaagtgctgggattacaggtgtgagccaccgtgcccggcctataccttattttcatcaaataaaatatatgaccttaaactacctgtgtcatacttattaaaatgagaccattaaacaccagtattcactaaataaaaaaaaaatttaaagtcaaaaattaatactaaaacatttgtttttcttgtcagatctagcccaaatgtcctctgtctctcttctggcttcaatgctttctatctttccctacatgtatactagcttgcagtggcttcccacttcattactaatctacacctaacagaccgtaagatgtattgaaagatttgttactaatgagtatcaaagttataacctattttatgttatttcaacaacattattcttagtcatttgcattctgcttagatttctaagacaaaaagatagaggttaaaagctagactcagagcctatctcaaccacgtggcttcagtagaacaaaggttaagaattgttagcttaaggcaatgacgtattaaaaacacttaaggccaggtgcagtggctcacgcctgtaatcccagcactttgggaggcctaggcaggcagatcacgaggtcaggagatcgagaccatcctggctaacacggtgaaaccccatctctactaaaaatacaaaaaattagccgtgcatggtggcacacgcctgtagtcccagctacttgtcgggctgaggcaggagaatggtgtgaacccgggaggcagagcttgcagtaagccaagatcatgccactgcactccagcttaggagacagagcaagactgtctcaaaaacaaaaacaaaacaaaaaaaacccaaaaaaccaaaaaaacaaaaagaacacaaacgaatgttcatagcaacattattcattatagcccaaaaataaaaacaacctaaatgtccatgaactgatgaatggataaaatgtgatataaccaaacaacagaatattcagcaataagaaggaatgcagtactggtgcattctacagcatggatgaatcttgaaaatagcatgctaagtgaaagaagccagacacaaaagaccacatatcgtataattccgtttatatataatatctaaaatagacaaattcatagagacagaaagtgtactgactgcctagggctggggaaaatgaaggtaacagggtttctttttggggtgatgaaaatgttcttaaattgtagtgatggttgcataactgaaaaccaaaaccactgacttgtatactttcttttttattttattttttgagacagagtctcgctctgtcgcccaggctggagtgcactggcacaatctcggctcactgcaagctccacctcctgggttcacgccactctcctgcctcagcctcccgagcagctgggacaaaaggtgcccgccaacatgcccggctaatttgtttttgtacttttagtagagacggggtttcaccatgttagccaggatggtctcgatctcctgacctcgtgatccacctgccttggcctcccaaagtgctgggattacaggcgtgagccattgtgcccagccaacttgtatactttcaaaggtaaactgcacaccatgtgaattatttctcaagaaagttatttagaacataaattataccaatactttatatatacattatgtatttttttcaaatatttcataatttaaaaaacacaaaagcctacagtgttacagtcagataactgatctcaaaacaaattacaagctgttgatttattactttttggtcattaaaatgaggaattcatgatacatacaatataccaaggttatactacaacaactgaagcgtgacttttttttccctccgcaaattctcactctgttggccaggctagagtgcagcggtgtgatctcggctcactgcaacctctgcctcccaggttcaagtgattctcctgcctcaacctctcaagtagctgggattacaactgcccgccactgggctaagttttgtgtatttagtagaaatggagtagtcaccatgttggccaggctggtcctgaactcctaacctcaagtgatccacctgcctctacctcccaaagtactgggattataggtgtgagccaccgtgccaggcctttttctttttttgagatggaatctcactctgtcaccaagggtggagtgcagtggcacaatctcaactcactgcaacctctgcctcccagattaaagcaattttcctgccacagcctcccaagtagctcggattacaggcatgtgccaccatgcctggctaaattttttttggtatttttagtagagacaaggtttcatcatgttggccaggctggtctcaaactcctgacctcaagtgatctgcctgcctcggcctcacaaactgttgggattacagttgtaagccaccatgtctggccttaacttttaaataagaatattaatgggggcacacacagatgatacatttaaaaacatacacctttaagtcagttgtttcttctatattaatttactaaaaatacaagtgcctacaatatcacatcataattttagcagggcacaagagcttacttttaaaaataattttaggccgggcgcggtggctcacgcttgtaatcccagcactttgggaggccgaggcgggtggatcacgaggtcaggagattgagaccacggtgaaaccccgtctctactaaaaataaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccgtctcaaaaaaaaaaaaaaaataaaataaaataaaataattttaaatgttctgactaaaatacaatagaacatgtccgtaggagactaacgtataaagtgacaagtttgaagccatactccccaaggttcaatgtggtacacattaccccagatctttgtgcattaaaaaaatttcatttctcttggaaggccgaggcgggtggatcacggggtcaggagattgagaccatcctggctaacacagtgaaaccctgtctttacaaaaaaatacaaaaaattagacaggcgtggtggcaggcacctgtagtcccagctacctctgaggctgaggcaggagaatggcgtgaatccagaaggcagagcttgctgtgagccaagatcacgccattgcactccagcctgggcaacagagcaagactccgtctcaaaaaaaaaaaaaaaaaaaaaagaatttcatttttcatttatgaaaaattatcccatcttttccattccctacaatcaatttcaaatcagagattaaaacattatttagaaaaagtataatttcaattcaaaagtgtataatcaaaataatctaacaatagcatgaaagctttttaaaattaactaaaattatacttagggacaatgcaagagtaatttaagcctcagacagttgtatttttttatttttattttttagtaatataaagagagaagcaagtagtattttataaatttacaaaacaaagtcacataactacaaaaaaattgtcaggaaaagatgctgagtgattacttaccatataatagccagtatgatagccactcatgtaccatgaaattaacatacttcccaaagcatcagcatcatcaagagaatctggacatatgggaggtggtgggggaattatctggagacagaaaaagatattgtttatatccagtaaacaaaaaagtaaagtctggagatttatattatatagtgaatgctggaaattaattgtatttttgcttatataatctcctacttaaatttcttttttttcccctaaacaaagacgaggtcttgctatgttgcccagactggtctcaaactcctgagctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagcaagtgacataaaaagtttaaacattttgatttagactatgtatctgttccactatgaagctatgagtaaaaaaaaaaaatcaagcataaatactttcatgcttttccttaatacacacacacacacacacacacacacacagctcacatagcatttcgagggcgattttaagtaaatgtcttgggtagaacacctgttctaaccccatcccaatacacagtatgccaaaaagtatctttttatctattgttaatacctaaaaatctaccattagaaatccagtttacagctgggtgcggcagctcacgcctgtaatcccagcgctttgggaggccaaggcgggtggatcacctgaggtcaggagttcaagatcagtctggccaacatggtgaaaccccatctctactaataaaacaaaaattagccgggtgtggtggcagtcgcctgtaatcccagctacttgggaggccgaggcagaattgcttgaacccaggaggcggaggttgctgtgagctgagatcacaccactgcactccagcctggggtacaagggcaaaactctgcctccaaaacaaaaaaaaaaaaagagagagaaagaaaaagaaatccagtttacatcagaagctaacatccaactatacctagaagggcaaacactaattccttatataaggtataattaaatcccttctaacaggaactacctccttatggcatagacaccaacttctgccaggaaagaaggcaacctagagcttagacttgggactacaagagcactgcatctgggtaacagaaaggcattaaaaacaaacaaaacccagaggtttagttcaaatttctacccattagaatctggcccaagggatgttctacaatgacattttacaatcctctattctgctaattatcaaattgtatgtgaaagcaaaatctaacctatactcttttttacttactggtggtccagaaggaaatggaggcagccagcatgatagtaagtggggtggtggtggtggcggtggcggtggtgggccattgaattttagacctggctataaggaatatttcaaaggaaaattaacttaccaatttcaatatgataggaataaaaaggactcaaaaccaaaaggataaaaataattacccagaatatttgttttatacatatcaaaaagattaagtgaaatttcatgtaccaaatcctgaagtcaaacagactcataagtcaaatgacaacctctggatttttctcatttcctttctatgtagacattaaggaagtaaaacaaaataagagtggtgattacctaataaatcagagacagtctatttagcaaaattatttcaatcataaaagactatatcccaaatttcattaactaaattgtatatttttatgaaagcctgtttagctatacatgccaacttagaggacatattgtgaaaactagcaaatctctccttataaaaatcagccccctgagaccaatgaagcatgatgtatatatcctaagagggtacatcattttagattcaagaaactgtaatataatgtaagcctcaataagaacattatcacagaaaatcttaaaacttttggtgagtcatgcttgttttttgaaaatgactgcctaggctaggcgcctgtaatcctagcactttggaaggccaaggtggggagatcacttgaggtcaggagttcaagaccagcctggccaacatggtgaaaccccatctctactaaaaatacaaaataagccgggtgtggtggcgggtgcctgtaatctcagctacttgggaggctgaagcaggagaatcacttgaacccaggaggtggaagttgcagtgagctgaaatggtgccactgcactccagcctgagcgacagagcaagactccatctcgaaaaaaaaaaaaaattgcctaaataccattccctccatggaagaaatcaccgctttacacaaaagaactagaaagggacaagccttaaggttccatgacataatctaacctataataaaaatctttttagagttgatttctgttacttataaccaaaaggaccataaatgaaaacaatatttacatttgaactctacaaaacaatctgagagcgcctcaggattttatctatattagatgtaaataatgtgttcttattttacatatcttatacaggtgacatgggaaacaacagcatatcatccagctaatgataaattattattacacttttttttgttttgttttgtttttttgtttgagatggagtctcattctgtcgcccaggttggagtgcagtggcacgatcttgactcactgcaagctctgcctccggggttcacaccatcctcctgcctcagcctcccgagtagctgggactacaggtgcccgccatcacgcccggcaaatttttttgtattttcagtagagatggggtttcaccgtgttagccaggatggtctcgatctcctgaccttgtgatccgcccaccttggcctcccaaagtgctgggattacaggcgtgagctaccgcgtccggcgcattattatactttctaacttaagtaagtgtgctaattattagtctaatacctaatactccacaaaagttaactggataaatctttcatataaagtattttgttgcatccactgcagtgtctaacatttttttaaaaaattaactattttgcatcattatcttatttccttttcaaaaaattcttgtgtatttaagctacaaaagtttcatgggagagctacaaattagttaacagagaggttaaatgtcccgacattaactattttctggaaaactttcatagaaggtttacctttcctggtcccagtcttggccctggcatggggggtggtggagggagaaaagagttccatggagcagatttgggcttgatgttatctgatttatttccaggagacctggagttctcactttcatctgttgaaacttggctttcattttcattctttaaaaagaaaaaatatgcaggtttttgttataagggtgtgattaagaaaaaattaatgcctcggtggatcaaactgacaactgtgtatactgtttaacagtttctcatctagtctctgcttccagaaattgaatttttttttttttgtatccttacctcttgagcattttgttctatattattagctacttcacagattggggaaagtagatcggacagattttgctcctctctatttccatatccagtgtaaaccacaacacaggtttctctcttaaaatcaattgaagcaatggtagctgggtaaatgcaaccgtcttctgaccaaatggcagaacatttgtccccaactttccactacaaaagaaatcaaagatatatacatgcacacatttcttttgaagagggcaaactatcatctcgttttgatcagtggggaggtgaaggatagagggtagagatttggaaggcaaaatgatgtaatgagaaaggcttggggtctaaatacataaatctgaattccaactctcttacatttataatcatggacaagtttctgaatctctttgagtcttagtttccccatcttattagatggctataatataaactacctcccatatttgttgtgaatagcgggagggagataaaatgcgtatggtgcccagcactctggactggcctagagcaagtgctcatcaactgttagctctcttcccccttggtaatgatgaaactaaagttggctcaaaagacaccaaaatattcagctttcaggactactgcttttaactagcagaaataatctacctagacttctgggttccttggaattaacagttttagagtttttaaagaaaaaggggaaaaaaaaatctatctctcagcttaagatgtaaaacactgccaattcagcttacggctcttgggtactccttccaaacggcaccttctccctgccttccattcacaaatggaacacatgtcctgattttagcatttatcattcccatctaattctttatactttcatgactaatatgcatgttcctaaataacagaaaatttaatagttgtttttgaagttgtataagtatatgtcaatagaaacactgtactaatcacttaagttaaagacattttacactattaaataaggactaatgagacatcctttgaagttaaatctcaacattttaaaataacctgttgtaaggaagctgcagtattcttcttttggcttttattcttcttagcaggttttcttttaggtgtggtttttggtttacccgaagtttcacaaatgtcaccattctttagagcatgctacgaaaataggaataaaaatgtacatgttacagggtggtgcacagaataaaagtcacgacataacccagttactactataagctagtctcaaggctccgtcacctcagaaagcacctattttctcttttgaccaccccctgcactataaaaactgctcttaaaggcatcatacacctgacatcagctctaaagacccttttaatcaaatctccttgctctcaacctctctgtaacattagaccctgttaattatctttcttcctgatattcatggccctttggatgtcatagcaatgtagggccccaacggtttcattacttctgatcaagccttagatttaggcattcccaataagagctggccatccttctttacttgcttacggccattattttatttattttatttttttacacagagtctcactctgtcaccgggctggagtgcagtcacactgatctcagctcactgcaacctccacctcccaggttcaagcgattctcctgtctcagcctcccgagtagctgggattacaggcgtgcaccactgtgcacagctaatttttgtatttttaataaagacggggtttcaccatgtgggccaggctggtcttgaactcctgacctcgtgatttgctcgcctcagcctcccaaagtactgggattacaggcgtgagccaccgcgcccggccaaggccatctattcttattactttagttgcaactgtctgcaaacacacttctgaagctattaatccagctgtgacttttctcaatctaacatttccaatgatcaatttcacatcttaattcatacctcaaactcaacctcaacttaattcatattcaacctcaacttaattcaaattcaatctcaacttaattcatactcaaactcactactaaaactatcgttttcccaaatcagttcttttcctcctttactcagattacttctccctgcaatatcaccaacccatcccacatcgagccccatttcaatctctattttatagaattctcttggtaattctttagtcgacttctagtttcagtgtatactggaaagcacatttaaaaatctaggccgggtgcagtggttcatgcttgtaatcccagcactttggaaggtcaaggcggagggatcttttgagctcaggagttccaggccagcgtgggcaacagggtgagactgcatctctacaaagaatacaaaaatgagctgggtgtggtggcacacacctgtggtcccaactactcaggaagctgaggtaggaggattgtttgagctcatgagttgaaggctccaatgaggcatgatcacgccactacactccagcctgggtgacagggcaagaccccatctcaaaaaaaaaaaaaaatctagaaatcagttacaaaggtgacatagaggtctgatctttagctcatgttacaagagtaactatgagaaagacatgaaatctgtatgcttggtgctctttatacactgtatgagtatatgctctgtttgctcaaggtagtctggactattgtttgctcaaggtagtctggactattgatgacccatatttagtgctcagtaagactaaacatctcagagaatggagaaggtgatgatgttggccaactgtgtaagtgtcctgtttgagacacagaaccatactacatttcctaaaagaactgtatattcctacccaataggaacacttgaattgatacccaacttacaggatttgggatgattagagtaatttaatatatgaaacgcacacagagcactgtcagcatgctacaaatattaattgctgtactaatgctatttatcttcatcattattttactacatgcttgttaaatgtttaaaattataattcagattgtctttttcttattaatctcaattagaggacttccatagtttgatacaatgtaaaaatactaaaaggaatacattgtttgttcgttttctgagatggagtctcactctatcgcccaggctggagtgcagtggtgcaatcattgcaacctctgccccccaggttcaagcaattctcctgcctcagtgtcccaagcagctgggattacaggcacgtgccaccatgcttggctaatttttgtatttttagtaaagacggggtttcaccatgttggccaggctggtctcaaactcctgacctcaggtgatccacccgcctcagcctctcaaagtgctgggattacaggagtgagccaccatacccagccaggaataaatgttttaaattttatttaaattgcctccacaaaggatgacatatataggctatcaacttctaaaggaggatatcacctgatttaactaactcatactaccatctaatcttcaaaatgaaaactgaataacatgtactttaacactttatcgtatgttatcaattcctttccaaatgaataacgagaaaataagaaaacgactaagcaagcatttcataccttaaatgaagccacagctttatcatatgcttttatcagtgctgtatcatcccaaatgtcagaatcatcgctctggaaagggtaagaaataaaaacaactcatgttcagataggtttaatcagaaaatgtatgttagtaccaagagtcatcttaatccacacataacaaaattacactgaaaatgagtatttaaaatcctaaataaagccacaggaaacttacctggttagaggttatgtgactttactccaaaagctagacataggtaaatgttctaagaatgaatgccatcaagtgaatgcccctacaatttaattcctatccacataccatgagtagatttgttcaaggccagctatatttatttcaattaagatcagataaaacttgacttcatctagactacgggaatgctgttctgacctcagaacctatgatccaaagaatattttttcttttgaaattataatgtttccagattataaggatacaaattgttaatagtgactaaccaattttcattttattattattattatttttttacttccatttccctttcctgctttcctggtaccaattttctttccttccttttcttttcctttctttcgtttctttcttctctccctccctccttcctttcttccttccttcacttctctttctctcttctttttttctcccctcaaattcctgtgttcaaatgaccctcccacctcagcccactgagtagttgggaatataggtgcatgccaccatgcctggctagtttttaaaattttttgtagggacggggtctcgccatcttagccaagctggtcttgaactcctaggctcaagtgatcctccagcctcgctcggcctcccaagtgtgggaattacaggcatgagccactgcacctggaaatatttttgtccagacatggtggctcatgcctgtaatcccagctacttgggaagctgaggcaggagaattacatgagcccagttgttggaggctgcagtaagctatgatcatcccattgccctctagcctgggtgacagaggaagaccctgtctaacaacaacaacaacaataacaaaataataataataataaataattttttagcactatctgctagcactgtgcaagtcactgagagatatatagaaacatggtactctccagttattatctaactagggatttaagactatcacacaagacaaaacaaaaaacaatataaaacaaatcttaacaaacatcaaaatgtgaaatacaaacagtattttaattaaaaaggaaagaaattaatgtctactgcaagatcatatggaggaaaccggcctaagaaataaaaaccactcacgcctgtaatcccagcactttgggtggccgaggtgggtggatcacgaggtcaggagttcgagaccagcctggccaacatggtgaaaccctgtctctactaaaaatacaaaaattagccggacatagtagcacatgcctgtaatcccagctacttgggaggctgaggcaggagaatcacttgaacctgggaggcagaggtggcagtgagccaagatcgcgccactgcactacagcctgagagacatagcgagactctgtctcaaaaaacaaacaaaacaaaacaaaacaaaataaaacaaaacaaaacaacaggatttaggccgggcatggtggcttgtaatcccagcattttgggaggccaaggcaggtgaattgcttgagtccaggacttccagaccagcctaggcaacagggtaagaaccttgtgtctactaaaaatacaaaaattctggccgggcgtggtggctcatgcctgtaattccagcactttgggaggcagaagcaggcagatcacgaggtcaggagttcgagaccagcatggccaacaaggtgaaaccccatctctactaaaactacaaaacttagctggcgtggtggcagtcacctgtaatcccagctgcttgggaggctgaggcaggagaatcacttgaacccgggcggcagagattgcagtgagctgagattgtgccactgcactccagcctgggtgacagagtgagactctgtctcaaaaacaaacaaacaaaaaaaccaaatttagctgggcatggtggcacatgcctatagtcccagctacctgcaggggctgaggcgagaggatcacctgggcccaggaagttgaggatgcagtgagtggagatggcgccgctgcactccagcctgggtaacaaattgagaccttgtctgggaaaaaaaaacaaaaaaaaacaaaaaaaacccccaaaaaaaaaaaaaacccaacaggatgtgcataggtagacaaaatagaacgcattccaagtaagagcatgaacaacaacaaaaaaggcatggaagcaaaaataacactaactataagaatttatttatgtaaggtaactaagtagtcaaatttatagaattagaaagaatgggccaggcgcagtggctcacgcctgtaatcccagcactttgggaggccgaggtgggcagatcacctgaggtcaggagttcgagaccagcctcaacatggagaaaccccttctctactaaaaatacaaaattagccgggcgtggtggtgcatgactgtaatcccagctactcgggaggctgaggtagaattgcttgaacctgggaggcggaggttgtggtgagtcgagattgcaccattgcactccagcctgggcaacaagagtaaaactccatctcaaaaaaaaaaaaaaaagaatgatgattaccaagggctaagtgtaaggagaaatgggaatttgctaatgggtagagtttcaggttgcaagacgaaaaacttccgaagatctattgcgcaacaacatgaacatacttaatattactgaactatatacttaaaaatggttaaaatgacaaatttttttacttcaataaaaaataaaacacactgtatgagggattagtgagacaagtccaaatagaatccaatttatactatagggtagagttggatttggtatactagagagtattttggatttggtatagtattagtcaatgaattccaaaaaagtttgttataaaattcactgagttgtaatattactttttgtcattttcctgttttttttttgttttgttttgttttctcttgagacaagagtctcgctatgccacccaggctggagtgcagtggcatgatctcggctcactgcaacctctgccgcccaggttcaagtgattctcctgcctcagtctctcaaatagctgggattataggcgcccaccatcaagctgggctaatttttgtatttttagtagacatgggctttcatcatcttggcaaaactggtctcgaactcctgacctcaagtgatcctcccacctcagcctcccaaagtgctgggattacaggcatgagccaccgcacccaggcttgtcattttcctgttaatctccgttatatagagacaaatgtattccaatataaaatgtcaatcttgctgtatgataaaaagtacttaataatcccagcctgggcaacatggcaaaaccccatctctacaaaaagtacaaaaattagctgggcgtggtggttcacatctgtagtcccagctacccagaaggctaaggtgggagggccgcttgaaccagggaagaggagattgcagtgagtggagatcagagatcgtgccactgcactccagccagggtgacagtgagaccctgtctcaaaaaaaaaaagtacttaagatcattaagtcactttgcagataagaaaagtaatcacaaagaggttaactgacttaaggttacattcgcacttggaagggaagatattccttggagatttggtaaaaggaataaaaacaggctgggtccagtggctcacacctataatctctgtctcgaaagaaaaaaaggggggtaggggggaggctgggcacggcagctcattcctgtaatcccagcactttgggatgcagaggtgggtggggtgggtggatcacttgacatcaggagtttgagaccagcctgccaatgtggcaaaaccccgtctctattaaaaatacaaaacttagccgggcatggtggtgcacacctgtagtcccagatacttgggaggctgaggcaggagaattgctggaacccgggaggcagaggttgcaatgagccaagatcactgcactccagcctgagtgacagagtgagactccatctcaaaaaaaaaggaagcaaacagtagaaaatgaagggtggtcctgaagaaataaagaaatcacaaaatcaaggccagtgatatcaatagaagagtgcagtcttaaagcaagatacatagacagatggcagctcaaactcctcatatctcaactgttattgccagaccaggaaacaagtaatttcaaaacgaacagaaaacaaagcgacagaagaaaaggtaatactgattacaaggtacccaaggacaaatacatctgactgaaaatctaaggagcaccaaagcaaagccatgaaaaagaaccaaaggaacaaaaataaataagaagcaaaatggttgatacattggcaaacagtatttatttaacgtatgtataaatggggtccctgaagaataaaaacaaaacaaaacaaacaatcttcctggtggtctagtgattaggaatttaaaaaaaagaaaaattcctagggatgggaggaagaaccccctcccatcctcagagagcctctaagcaaaaagactaagttacaaaataaagaaaatcagttatcattagactttctcatagaaatttatggggaaaaagtatgagccaagaattttatatgcagcctagctgtccttgaagtagcaagactaagaaaagtctaaaatgtagaagaataccgtactcactagcctttccagggtaatctattgaaaatacgcttcatccaaccaagatatgaccagggaaacttgggttttaaaaataacagaactggccaggcatggtggttcacgcctgtaatcccaacactttgggaggccgaggtgggtggatcacctgaggtcaggagttcaagaccagcctgatcaacatggtgaaaccccgtctctactaaaaatacaaaattagccgggcgtggtggcgcatgcctgtaatcccagctactcgggaggctgaggcagaagaattgcttgaacctgggaggtggaggttgtggtgagccaagatcgcgccactgcactccagcctgggcaacaagagcgaaactcttgtctcaaaaaaaaaaaacgaaaaacataaaacagaattgttagcatcaaatatatttaattgtggatctaagaggaaagtagtgtattaaattgaaaagctgattctaaaatttatatggaactactaaggacaaaaataaaccaaagctggacaatttacattatctaactttaagactgtaaaccagaagtagctaagacaggtttcaatcaatttagaaagtttattttgccaaagttaaagacgctcctatgacacagccacaggaggtcctgatgacatgtccccaaggtggtggggtacagctttgttttatacattttagggagacatgaggcatcaatcaatatatgtaagatgtacatgagttctgtcaggaaaggcaggacaactcaaagtgggggtagggaggtttctaggtcataggaagatttaaagattttctaattggcaactagttgaaagagttattatcaacagaaaggaatgtttgggttaccataaggggttgtggagaccaaggttttatcatgcagatgaagctcccaggtagcaggcttcagagagggtaggttgtaaatgtttcttttcagactttaagagtctgttctatcagtaattccaaaaggtagtagggtgtgatgagacatgtccaactcccccttcccatcatggcttgaactagtttttcaggttaattttggaatgcccttggctgagaggatgggtccattcagttggttgtgcaggggcggggggggcctataattttatttttggtttacaagacataccctgaagcaatagtaattaaaagtgtagtactgacatcaatatacactaatagacaatgtaacagaattgagagtcagaaatagccctgtgatatatgtgactgattttaactaaagttacaaatgtggtttaatagagaaagcatagtagtttcaagaaatggtggtaaaactattggaaatccttatgcaaaaacaaaccaaatttccacctacactgagccacatataagaattaatacaaaatggattacagacctaagtgtaaaactaaaactctaaactgtgtaaaaaaaaaaaagagagaaaaatctgtgatcatggattgcctataacaaaagaacaaactgaaatggccttgttgcctggggtggcacccgaggttcttggtctcacgctgaggaaatcaaggacgctgacacaccaagggtgtgaggctagagcagaagtttaataggcaaaagaaagagactagctctctcctgcagagagaggtcctgaaaagagttcccattccacagtgaaatgcaagcatttttataaatgagctaatgggaagggggtagcttatctacacatagggagcaaaaaaccagttaggaccaggtgttgccatctgcacagagcgtgaatctctggcatcccccaccccaaccttttattatgcaggcaggtccttggcctgagctactccacattgcttatctctttcctattgtgcatgtgctaaataaggggaggtggagccaccatggtggacatgcctggccccaggtacccctttctctccgtgcagctgcaggcaaccccaacaactcacaacatgcaagcttccagcttccttatctgagtatgtactaaggtccactgtgtttacttcacatactgtgtttacttcacatacccaccttacgtatgtgaagcttgctgattacccaggaagctccccctctgtgccagagctgcttccttatacatgtttacagcccgatcttccaggctgctccttgttagaagagaagtgatttcttgggctgctttttgttagaagggaagttctaccgaggactctgtctaactatcggcttacctagtctttttttacctcctctctcaaaaccatcaaagaaaaaactgaaaaattagatttcagcaaaattaagattttctgttcttaaaaagacgttgttaacaaaatgaaaaaccaaagtgtaaaccgggagaaaatacatgcaagttacctatctgataaagatattgtacccagcaaacatgaagaactctcaaacctcaacaacaaaaaaattcaattaaaagatgggtaagttggccgggtgcagtggctcatacttgcaatcccaatctttgggaggctgaggcaggaagattgcttgagcccaggagttcacgacaagcccaggcaacataatgagaccttgtttctacaaaattttaaaaaattagccaggcattgtggcgtgtgctcgtaatttcagctactcagaaggctgagacaagaagactgagcgcaggaggtggaggctgcagtaggctgtgtgattgcaccactgcacaacagcctgggtgacagagtgagacactgtctccaaaaaaaaaaaacaaaaaaaaaaaaaacccaaatgatttgaatagacacttcaccaaaaaagatatacggatggcaaatacactcatgaaatgatcaacagcagcactggtcattaggaaatgctaattaaaatcacaagaagccactatatctattataatgcctaaaattaaaaagactgaccataccaggtgtttgcagggacactgagcaaatggaactttcatacattgctggtcaaaatgcaaaatgggggagctgttctgaacctatttagttgtgggggctgtccaacttttgaatttttctttgctcaattaatctctgttatattaaaaagtaacatggtacaaccaccactttgaggaagagtttgacagctccttaaagacttaaaatacatctaccctgagacctaagtattcactcaagaaaaatgaaagcgtatgtctatacaaagtcttctttaaaattttttatagaaaatttttaatttttgattttaaaataaaaatagaggtttcaccatgtttcccaggctggtctcaaactcctgggctcaagcgatctgccagccttggctatatgaagtcttatacactaatattcatagtggctctacttgttaacagtcccaaactggaaaaagcccaaatgttcacaagcaagcgaatgaatacagtatagtatatacatgcaatgggatactactcagcaataaaatggatgaaaatcaaaatagctatgataaataaaagaaacgtgacaaaaaaggtactctatcattccacgtttataaaaattcttaaaaatgcaggctaatctatggtgacagaaagtagatcagtggttgtctggggacaggacaaggagggatgaaaaggatcacaaaacagcaatccaactgaggccaccatgctataaggaaatccaaaccagcccacacattgaaaccacataaagaaatcttcatgagactacatgaaaaaaagagatagcctgccaatccctagctgctcagtccccagctactgtagctctagcaactatgtaggtgcaaccacgagacagccgcacgaaaactgcccagcacggctctcacaaattcctaacccacagaaacaatgagagataataaaatgttctttgttgtttcaagccactaagttttggcagattcgttacacagcaacggcagccagaacggaccaccaggactgcctttatatctgattctcagtcatttccagtagctcagatttctcaaattattcccaacaccctgccatcttctaccttctcctaccacttcctgaaacttccactgtgctcccttgagtaattcataaaatccactcttttaacctctgaatcatcccttcatttcttgctctaagtaaaatctagctccctgaggatgccttttcctttcgcagccatctcaaatgatagatgtttcctcttttctcctccacacacttcatatcactgtacctactggagatgtggggaagaaatcttccctgctctggctggcgcggtggctcacgcctgtaatcccaagcgctttgggaggccggggtgggcggatcacaaagtcaggagattgagaccatcctggctaacacggtgaaaccccgtctctactaaaaatacaaaaaaacaattagctgggcgtggtggcgggcgcctgtagtcccagctactcgggaggctgaaggaggagaatggcgtgaacacgggaggcggagcttgcagtgagcggagatctcgccactgcactccagcctgggcgactgagccagactccgactcaaaaaaaaaaaaaaaaaagaaaaaagaaatcttccctgctccttacttgcactttcagattattctcctccattcccctctcaaaattcccagccttgaaaatcctgacaaaaagtagccaggcatggtggtcagcacctgtagttccagctacttgagaggctgaagtgggagaatcccttgagcttgggaggaggttgtagtgagccgtgatcgcgccactgcactcccacctgggcaacaaaaagaggccctgtctcggggggggggaaaaaaagaaagaaggaaaatcttgtcaccagactcacagtctattatcgtttcctattgcagtcacctacagcctaccgagtcactcttcctcattccttaatgtttacatcgcagttctctctccaacactactcctgtcataatttttggtgatttaaatatccatgtagatgatcccttcaattaccctatatttgcaggtctctaaactcctctccaccacaatcttgtacatcctctgatgtggtgcagctctgtgttcctacccaaatctcatgctgaattgtgatccccagtgttggaggtgggcatggtaggaggcgactggatcatgggggtgatttctaatgatttagcaccatccccaagtgctgtttcctgataagcgttctcacaagatctggttgttttaaagtatgtagcacttcccccttctctctctctcctgctggccatgtgaagactgtgcttgtttccccttcaccttccaccatgactgtaagtttccttaggcctccacaagagaagcctgtacaggcagcagaactgtgagctgattaaacctcttatctttataaatacctggtctcaggtatgtctttgtagcagtgtaagaatgaactgatacatccccaaatctcagctactcactcacttcaactgtatttatttattataaccaataaccacaacctctccataaatgcagtttcaagaatcccactctcttaaccatcaccttctaggctctgcaacttactcctactagtgatttgatggggacaatcattccacttcattaggactggcagtacattgatcctcccactttttttttttttttttttttttttgaggcagagtctcattttgtcgcccaggatggagtacagtggcacgatctcgggtcactgcaaactccacatcccgggttcaagtgattttcctgcctcagcctccctagtagctgagactacaggcacctgccaccatgcccagctaattttttttttccaagaggagtcctgctctgtcgcccaggctggagtgcagtggcgcaatctcggctcactgcaaacctcgcctcccgtgttcaactgattctcctgcctcagcctcccaagtagctgggattataggcacgcgccaccacgcccggctaatttttgtattctttttttttttttttttttaaagacaaagttttgctcttgttgcccaggctggagtgcaatggagtgatctcagctgtctgcaacctctgcctcccaggttcaagcaatttttctgcctcagcctcccgagtagctgggattatagacacgtgacaccatgcccggctaatttttgtatttttagtagagacaaggtttcaccatattggccaggctggtctcgaactcctgaccttgtgatctgcccaactcggcctcccaaagtgctgggattacaggtgtcagccacagcgcccggccgatcctcccactttttaaactgtctctcagggtcttaaaatcctcacttcctttcttttttttttttttttgaggtgaagtctcactatatcgtccaggctggagtacagtggcgtgatctcggctcactgcaacctccacctcctgggtccaagggatactcctgccacagcctcttgagtagctgggattacaggcacctgccaccattcccggctaatttttctgtatttttattagagatggggtttcgccatatcggccaggttggtctcaaactcctgacctcaggtaatccacccacctcagtctcccaaagtgctgggattacaggcgtgagccaccgcgcccggcctctcacttcctttcttagccagcttaaattccatggtcaatcattaagagaactcctttgtacttctccccctcacttcttcatatccacgtggtaaaatcacaactgcattaatttcaactctccatttactctgtgggtgccctcatacacaatcttgctgtctggtctccttcaactcatgaccacgaatctcaagtaggctctttatgttgcctagcaatatttccactaaacttccctagtccaacccttgcccactcttctaaagaactatctacttcccatcttctctttcctctcccatcccagcttctagctgataaccttgcttctttcactaagagaacagtaagaatcaagagaactttcaaaatctcctgccatcctatctgcccattcacgtatcatagatgtgttaactatatagctgtcaccaaaagaaccgctaatgtttccaacaaaggccaaatccatcccttcttacctactctaggacattgctctagccattgtcttctttccgacatcaactttcccattctcatctttcctatcaacccacaaacatgctgaaacatgttgctcctatcttagtgcagtggctcacactagtaatcccagtactttgggaggcagaggtgggaggatagcttgaggccaggagtccaaggctgtagtgattcatgattgcgccactggcaccccagcagcctgggcaacagagcaagacccccctcttttaaaaccacacacacataattaaaattcctcttaactcacttccccctccatttattgcccaatttctctaccctccatttataataaaatttcgtggtggctcactcctttaggcccagcgactccaaaggagggtcgcttgaggccaagagatcaacgctgccatgggctaggatcatgccactgtactccagcctgggccacagagagcgaacttgtctctaaaaaaattttttttaaatagaattccttgaaatatgcctaccgatgtttttattatttatttatttatttatttatttatttgagacggagtcttgctctatcgcccaggctggagtgcagtggcgcgatctcggctcactgcaagctccgcctcccggcttcatgacattctcctgcctcagcctcccgagtagctgggactacaggcgcccgtcaccacgcccggctaattttttgtatttgtagtagagacggggtttcaccgtgttagccaggatggtctcgatctcctgaccttgtgatccggccgcctcggcctcccaaagtgctgggattacaggcttgagccaccgcgcccggccgtttattttgttttaagacagggtctggctctgtcgcccaggctggagtgcagaggcgcaatcacagatcactgcagcctccacctccctgagccttccaaggcctgaaccttccaggtagctgagaccacagacgcgcaccacaacacccgtctaatttttgcagactcggagtcacactatgttgcccaggctggtcaaatgttgccttggatttctcttctcctactctccaactcactccagccaaattcacccctaccatgctatgcccaagactgaactcctgagaaacctgctctactggcaatcttctctttcccacctcagcaaaaggcaactttatcttttcaactattcaggataacctccgttatcgaatctatctgaaaaacctgttgcctccgatttcaaaatatacccagaatccaaatactttcactctgttaataacatcttgttctgaagttcagatcatcttaacagactcctaagtggttcccctgcttcaccctggcctaatgcccccacctcccccacaccagccagagaggagtgaacaaaataagctactgccaagtcgcggcagggcctccactcaacgctatcaaggagcccaaactgctcgaggaaggagcttgcggatgtggttcgcagggaacggagtgggaaaagacgtagaaaaacgcggaccacaactccagtgagcggatcgacttgatgctgtcccgaggctgcggaaggagagttgggccggaagaagggtgctgagagcgctaatagggagactgcactggctgcgacctcacctggcctgtgccgcgccggaacagcacggaatcctcctgctccgggacgccgccaccactgccgccgctgctcatcgccatagcaaacccgcgggtgcgcagcgtggggccccgtcccttcttaagagtgacgacttccgccgcccggggcttctgggagcggaacagtacggtggccgggaggaccgcttgtagtaacttctcacgctttctacgagtggttatcgccctcccacatttgtggcgtgtatatttttcatttctctcaatcctttcatttcactgtgttatatttcctttccttttttttttgtttgtttgttttgagacagagcctcgccctgtcgctcaggctggagtgcagcggcgcgatctcggctcactgcagcctcgacttcttgggctcaagcgatcctcccacctcagcctccccagtagctaggactataggcgtgcgccaccacgctcagctattttttgtatttagtagagacggggtttcggcatgttgcttaggcctcgtctcgaactccagtgtgtgtgtgtgtgtgtgtgtgtgtgtgtgtgtgtgtgtagatatttattccccctcccccttggaaaagtaaatgtaagctcctactaggaatttaaaacctgcttgatctatataaagacaaacaaggaaagacaaacatgggggcaggaaggaaggcggcagatccttaaacactagaagatatttgatcccccaaccttatttgttgtttgttttgagacggagtctcgctctgtcgtcagagtgcagtggcaccatctcggctcattgcagcctcgacctcccgagctcaagcgatcctcccgcctcaacctcccaagtagctaggaccacaggggcacgccaccacacccggctagtttctgtatgttttgtagaggcggcgtttggagcatattgtgtaggctggtctcgaactcctgagctcaagatattccgcccgcctctggcatcccaaaatgctgggattacaggtgtgagccacctcgcccagcctccagtattcttttttttttttgcgacagagtattgctctgtcacccaggctggaatgcagtggcgtgatctcagctcactgcaacctctgcctcccaggttcaagcaattctcctgcctcagccccccgagtagctgggattacaggcgcccaccaccacacccggctaatttttgtatttttagtaaagatggggtttcaccatgttggccaggctggtcttgaactcctgacctcgtaatccgaccgcctcggcctcccaaagtgctgggattacaggtgtgagccaccacaccgggcctccagtattctttattaagcatctagggttgctaaatggcttatatgtacatagtatatatatatttttaactccacgaaaggaactttgagctcttcccccaaaatacccttggcttctatatagtatacaagaaatatctgtggaggaaggggagaatgggatgatgttgaccaagtgtacaaaaatggtaactccgtagaggtaatatgtggaatgtaatcatttcacaatgtatatctaaacatcaaatggtacaccttaaatatatacaatttttaggggtctggtacggtggctcatgcctataatcccagcactttgggaggccaaggtgggtggatcacttgaggtcaggagttcaagaccagcctggccaacatggtgaaaccctgtttctcctaaaaatacaaaaatcagccgggtgtggtggtgcaggcctgtaatgacagctgcttgggaggctgaggcaggagaatctcttgaactcgggaggcggaggttgcagtgagccaagatcacgccactgcactccagcctgagtgacagagtgcgactccatctcaaacaaataaatatgtacaatttttatgtgtcaaaaaagttaaattgtcacaagataaaaaaaaaaattttaaatctcatgtcaggaaagtaatgtgccaaaggtacatctcacagataaacatgaaaacctgcactccagcctgggcgacagagtgaggctgtgtctcagaaaaaaaaaaaaaagtaaaaaaaaaagtatgtttttataaagcttgcttagatttttctgaatcataaaaattctcacaattgcatttgatgtcaaaatttaaacaaattacgtggacatattacatgatggttaaaaaaataaatttaaacaaaatatagaaccaggtttctttttgttttttaatttttttctttttgagacggagtctcgctctgccacccagactggagtgcagtggctcactgcaacctctgcctcccgggttcaagtgattctcctgtctcagcttcccgagtacctgggattacaggcgtgtgccaccacgcccagctaatttttgtatttttagtagagacggggttttgccatgttggtcaggttggtctcaaactcctgaccttgtgatccgcccgcctcagcctcccaaagtgctgcgattacaggcatgagccaccgcacccagccatttctttttgtttttattatttagagatataattgatatactatagaattaatcattttagagagtacaattgaatggtagattgagcggaaaccttaatatattcacaaggttgtgcaaccatcaccactatctaactccagaacattttaatcacccaccaaagaaactctgtttcctttaacagtgcgctgccatgctcagctattttttgggagagaaggggtctccccatgttgtccacgctggtctcaaactcggttgcttaagcagtcctcccacttgagccgctgtgcccaggcctgagttactatatttataaaagttatttcatatgatagacaaatcattcaaaacataatgaggtaaactgccaaaagaaaccattttaccatatttgaaggcatttaatgtaaatgttgaatttaatttcatgtactggaatcagtctttttgcatatgtaattttcataccaaaaatctgtcttcagttgactcctggaactctctcatgataaaataaaagtttcaaataatgtcggggtggtggctaacacctgtaatcccagcactgtgggagtccgaggcaggtggatcacatgaggtcaggagtttgagaccagcctagccaacatggcaacactaaagatatgaaagtcagccaggcatggtggtgcatgcctgtaatctcagctactagggaggctgaggcacaaaaatcacttgaaactgggaggtggaggttgcaatgagctgagatcgtgccactgcacaccagcctgtgagacagagcaagactctgtctcaaaaaaaaaaaaaaaaaaaaaaaaaaaagggccaagtatggtggctcatgcctgtaatcctagcactttgggaggctgagtgggagaggatcatttgagcccaagtaacatggtcaggccccatctctacaaaaataaattagctgggcatggtggtatgggcttgtggtaccagctactcaggaggctgagacaggaggagtacttgagccaaggaggtcaaaggctgcagtaagccatgtttttgccaccgtgctccagcctgggcaacagagcaatatgctgtttcaaaaacaaactaaaaaaatggtagtacctacatgtgaagattgcatataataaagattgtaaagcagagagaaaaactggacagttcaccaaaaagaaaatccaaatgtccactagagatctgagaagatgcccaacctctagagccaaggaattgcaaattaataactaagataacatttcagggcctggcacggtggctcatgccagtaatcccagcactttgggaggctgaggcaggcggatcacttgaggtcaggatttgagatcaccctggccaacatggtgaaatcctgtctctactaaaaatacaaaaattagctgagcatggttgcggcgcctataatcctagctactttgaagactgaggcaggagaatcgcttgaacctaggaagcggaggttgcagtgagctgagatcgtgccagtgcactccagtctgagtgacagggtgagacttcatctcaaaaaaaaaacaaaaaaacaaaaaatttcaggaatatacctgcctttggtaaaaacaaaaagaaattgtgaaccaggcgtggtgactcatgcctgtaatcctagcactttgggaggctgaggcaggaggatcctttgagcccaggggtacaagaccagcctgggcaacatagggagaccttgtctcaaaaaaaaaaaaataaataaataaaataaaaaataaaaaaatcgtgaatagtgttgcgatgaataaaaaagaaaaaaaattaaaaagaaagaaaacccagaaaaactaacataccattttcctctcagtttggcaaaactattaggaattaataacatttgatgttagcaaagtatggggaaatgaacttttatcctcttattgaaaatatctgtttgtagccaggcatgatgacttatgcctgtaatcccagcaatttgggaggccaaggtgggaagatcccttgaggccagaagtttgagaccagcctgagtaataaagtaagaccccatgtcattaaaaaaaaaaaaaaaaaaaaaaaaaagaaggaaagactgccgggcgcagtggctcacgcctgtaatcccagcactttcagaggctgaggtgagcagaacacttgatgtcaggagttcaagaccagcctggccaacatggtgaaaccccaccccatctctactaaaaatacaaaaattagctgggcgtggtggcgggcgcctgtaatcccagctattcaggaggctgaggctggagaatcacttgaccctggaggcggaggttgcagtgagccgagatcacaccactacactccagcttggacaacagagtgagactccgtctcaaaaacaacaacaacaaaacccaaaacatctgtttaaagtttaagacatgtatacctgtgaaagttgattacataaattgggtcattcttgaaatactcaactaaatcagagttgaagggccagggggaagaagcattcggggcacacagcatctgcttcaagaattaaattttccacaagtccaactgctgaaccagccttctgtatccctaagaccagttttacctaatagctgctaaaatgaactgccatgactctaagactggttttacctaccaccatcgctcaccaatcagagcttgctagctcccacaagctctagtgtgaatgagctttcttccaaaacagtatgtaatactgttctttctcataaaacccggaaccttctctttttttttttttgagatggaattttgctcttgttgcccaggctggagtgcaatggcgcgatctcggctcactgcaaccttcacctcccgggttcaagcatttctcctgtgtcagcctcctgagtagctgggattcaggcatgcgccactatgcccaactaattttgtatttttagtagagacggagtttctccatgttggtcaggctggtctcaaactcctgacctcaggtgatctgcccgcctcggcctcccaaagtgctgggattacaggcatgagctatcacacctggccgcaaccttccctttattctcctgatcataccaatgatcagcctggtctgtgtgtatgccatgaattgcagctcttgcttaccaaataaaatgtttttagagatttgtctctatattatatttggctttgacataactattcccaaggaattctatctttaaaaatccattcttatagaaatgaaagcaccaataaatgggaataagtacgataatccacatcgcagaattgtttgtagtggcaaaagttgcaacatcctaattgtctatgagtaaggaaatgattgaataaattactgtacatctatactaaagttaaatttgtaagtactgaagtacaggcacggctattttttttttctttttgtggaaacagggtctcactctgtcacccaggctggagtgcagtggcaccatcttgggtcactgcaacctctgcctcctgagttcaagtgatcctcacacctcagcctcccaagtagctgggactacaggcacgtgccaccacacctggctaattttggtttttggcttctttcttaattggtatgtttacttaaaaatatagactaatgggctgggcatggtgacttacacctataatcccagcactttgggaggccaaggcgggtggatcatgaggtcaggagatcgagaccatcctggctaaaacagtgaaaccccatctctactaaaagtacaaaaaattagccgggtgtggtggtgggcacctgtagtcccagctactcgggaggctgaggcaggagaatggcgtgaacctgggaagcagagcttgcagtgagccgagattgtgccactgcactccagcctgggcgacagagcaagactccatctcaaaaataaataaataaataaataaaataataaaataaaatatagactaatgatcctgtgcttcaatgtcattgtggttatgtgctgatgtccataaaacataagttataagggactcttcacaaatacactccagacagaagggtaaacagaaatgactgacaagacagtgccatttcagacatacttcccttaattattaatacttgctagaaaatggagtttgacattatttacaattataccaatattcacagaggccaactgtcacaggcattaagggcacaccagggccaggagacctcatttcagacttcccaaatatttttatattttagctattaagatcagttaccagagctcaacttgttcttaacaagcagaatttttatgtccattcaaagagtctcttatacctttctgggcctatttacttgcagagaacagtagaaactgtaaccaggctcttcatatcatgcattcacatgtgatgtccaatcttcatatgctgtccaatttctttaagataaatggagtgactcgcagcagggccacgtagatgagaaagttctgtatggagatcatatcctcgtgcatcttccgtttcatctccgtgaggtccagcttccgggcaaggcccccaatccggaagatcagctgcctcgctctgctctccctaatggcccccttacacccggaactcggcctatcccctcgccccagctaatttttgtatttttagtagaaatggggtttcgccatgttgcccaggctggtcttgaactcctgggcacaagggatctacccgccttggtctcccaaagtgctcagattacaggcatgagccaccacgcctggcccaacatggctattattttttaaagtgctaaattatggccgggggctgtgactcacgcctgtaatcccagcactttgggaggccgaggcgggtgaatcacgaggtcaggagatggagaccagcctggccaacatggtgaaaccccatctctactaagaatacaaaaaattagctgggcgtggtggcaggcgcctgtaatcccatctactcaggaagctgaggctggagaatcgcttgaacccgggaggcggaggttgcagtgagcagagatcacgccactgcagtccagcctgggcaacagtgcgagactctgtctcaaaaaaaaaataaataaattacctgggtgtggcagcgcgtgcctgtaatcccagctacccaggaggctgaggcaagagaactgcttgaacccaggaggcagaggttgcatggagctgagatggcaccactgcactccagtctggtgacagagtgagactccatctcaaaaaaaaaaaaaaaaagtgctaagttacatctaagtttcctatttttgtttaaaaaactccttgtagtgggttgaatggtggaccccaaaatgatacatctgtccatctgatatgcgtgaatgtgacctatttgggaaaacagtttttgtagatgaaattaaggatttccaaatgagatcatcctaggttagaatggaacctaaatccaacagcaaaagtcctcataaaaagaagggaagaagacagaaaagaagaccacaaagacaaaggcagagataggagttatgctgccataagccaagtaatacctggagccaccagcagctggaagaggaaagcaaggattctcccttggagccttcagagggaggtgtggcccagctgacatcttgctctcagatttctggcctccagaactgtgaacagaaatatttctgttgttttaagccactaagtttgtggtaatttgttacagcagctctcagaatcaaatacattcccacaccccttatttatgtgtatgtgtgtgtatgcatgtttgcatgagcactgagagaagcataccattattaacattggttagttcaggggaatgagactggcttactgaaggctgagagagtatacgtgtgtgtatataaattgagtgtatttaaattaagtatatggaagtaaattaagactacaatgagataccactacctcccaccaatatggttaaagataaaaggactgataatacctaatgctggtatggagcaatggaaccttcctttattgctggtggtaaaatggtatggtcattaaaaacaaactaaaacaaaaacaacaaaaatgcaattgtttgatggtacctactaaaaaatgtgtgtatgtgtgtgtatagacacacaccctatgacccagcaattccattcctggcatatactcagtagatagcgtgtttaagaccatcataagatatacaaaaatgttacggtagcattattcataacagccccaaagtgggagcaattcaaaggtccatgaaatgtagagtaactaaattatggtatattcatataacagaatgctacacaacagtgaaaaaggctgaactgctgcatagcagcaaaatagagaattcttttagacgtaacgttgagcaaatcaagctaggctcactacagcacataccgtgtgatcccatttacaaaaaattcaaaaacaggcaaaactaatctatggtgataatcagatgggaggcattatctaagagggtgctggaaatgtcctttattgtgatctgaacatagtattcatatacgagtcattgaaatatacatttcaaatgctggctgtttattatcatttcactgggataaatgcccaaggagttagttttcaaagagatgctatttagaatttatggaaatttagaacttactgtattttcccagattttctataatgagcaagcattgcagtttgagggtttgaaagattggtagagacaaaaactgcataagctgcatgattatttctcacacttcagatgcttaccacctttatgatttgccatatcatgtattttaaaaaatacatttttttctttttttagatggagtctcattctgtcacccaggctgcagtgcagtggtgtgatctcagctcactgcaacctcctgggttcaagtgactctccggcctctgcctcccgagtagctgagattacaggcacccatcacaatacctggcaaatttttgtatttaaaaatacagccaggctcggtggctcacgcctgtaatcccagcactttgggaggccaaggctggcggatcacctgaggtcaggagttcgagaccagcctgaccaacatggtgaaaccccgtctctacttaaaatacagaattagctgggcgtggtggctcatgtctgtaatcccagcactttgggaggccaaggtgggtagattgcctgaggtcagttcgagaccagcctgaccaatatggtgaaacctcatctctactaaaaatacaaaaattagctgggcatggtggtatgctcctgtagtcccagctactcaggaggctgaggtgggagaattgtttgaattcgggaggtggatgttgcagtgagctgagatcgcgccactgcactccagccgggcgacagagcgacactccgtctcaaaaaaacaaaaacatacaattttaaaaatttagtcttagcttttcaataagagggattaaaatatattattttagtctgctcagcatccattctcccttccttttggcaaagaaccctaaattttttgggggatgatatagtttggctgtgtccccaacccaaatctcatcctgaattgtagctcctataattcccatgtgtcatgggagggacctggtgggaggtaattgaatcatgggggtggttaccttcatgctgttctcatgatagtgagtgagttctcaggagatctgatggtttcataaggggcttttccccttttgctttgcacttctccttcctgccatcatgtgaagaaggatgtatttgcttccccttctgccatgattgtaagcttcctgaggcctccccagccatacacaactgtgagtcaattaaacctctttcctttataaattatccagtctcgagtatgtctttattatcagcatgagaacggactaatacaggggaccacctactccttactagagttggttttaccatcaacttgccctcctcttgctgagggatgggtacctaacccatgtaacttcagttggaggcactccaagtgacataaaaactaaatatacatgtcagaagttcaacctgatatcagcactgtaagaaaaaaaaacaaaaacaaacacctcataacacctactcttaagatacctgaaactgttacaattcttgacctttccaaagccttgagtcctcaacttttccatgactctggagtctctcattctttcaaataagatttttatcagtaagttcattaatctgatcctgttgcttgcaaccaaaaattccaatatatcatgaaatcaggttagatgtggttatattacttcaagtatatactaacccatttcccgtttgccccaagaatactcttgcctctaatcctaatgtaacattatatacatttccattatattaggattagagacaagttctgtttagaaataactctaagaacagtttgtgtattttcacattgaaaattaatttgcgtcaacctcagagtgtgtttatgtaaaattaaatgagcgctggcagccagctgcactttttttttctttttttctttttttttttttgagacggagtctcactctgtcgcccaggctggagtgcatggagtgcagtggcatgatctcggctcactgcaagctccgcctctcgggtctatgcctttctcctgcctcagcctcccgagtagctgggactacaggcgcctgccaccatgcccggctaatgttttgtatttttagtagagacggggtttcaccatgttagccaggacggtctcgatctcctgacctcgtgatccacccacctcggcctcccaaagtgctaggattacaggcgtgagccacggcgcctggccacttttattttctaaacaggaaatgggttaaatacgtaactctgtatgaaatatccattcataagctaccctaacagcccccttgagtggtataaggctacagtctttgaccaaaaaaaaagtatttgacaaaaacttatgtcatgtgatatatgttcataaaaggcaagtatttaataggattatgtcaattatagccaggctggtaggtaaatttcttttaaataccaaggctcagccagactgctgcaaggaagtgttccagaacttatgtaccagcaagcagtcttgtccaagtggtaaaacagcaagagtagtatgtggaatggaaattcggtttgtatgttttttttttttttttttttttgagacagagtcttgttctgttgctcaggctagagtgcagtggtgcagtctcggctcactgcaacctttgcctcccagagtcaagaaattctcttgcctcagcctcccaagtagttgggattacaggcgcccaccaccacgcttggctaatttttgtatttttagtagagacggggtttcaccatgttggccaggctggtcttgaactcctgacctcaggtgatctgcccacctcagcctcagcctcccaaagtgctggattacaggcatgagccaccatgcccggccttgttttttatttatttatttctttgagatgaagtcttgctctgtcacccagactggagtgcagtggtgcaatctcggctcactgaaatctccacctcctgggttcaagcgattctcctgcctcagcctcccaagtagctggtattacagg

SEQ ID NO: 5 - DNA, 52073 bp, Homo sapiens
tgctcctgcagcagggttctgcttggacacccaggcttttccatacatcctctgaaatccaggcagaggctaccaagaattcaccatttttgcattctgtgtgcctgcaggcttaccacctaatggaagctgtgaaggctatggcttatgccctccaaagtaacagcccaagctgtacctaggcccctttgagcccctgctggagttggagccatctggatgcagggagcagtgttctgaggctgcacagggcaacagggccctgggctcagcccaggaaaatattcagtcttccttggcttcagggcctatgacaggaggggctgccccataggtctctgaaatgcctttgaggccttttccccattgtcttggatattaccacttggatccctttcagttatgcaaatatcagcaagtggttgctccacagcctgcttgaattccttggagaaaatggtttttttttttaccacctggctaggctgcaaaatttcccaacttttaggctctgcttcctgtttaaatgtaagttccaaatttaagtcattcatttgcccccacatctgagcacaggctgttagtagcagaaggccacatcttgaatgctttgctgcttagaaatttcttctgccacatacgctaggtcatagtttttaagttcaaacttccacagatccctaggacacaagcagaatgcagccaagttatttgctaaggcataacgtgtgacttttgctccagttcccaataaattcgtttccttttgagaccttgtcaacctggacttcactgtccctatcaccatcagcattttggtcacaaccacttatctagtctctaagaagttccaaacttgccgggagcggtggctcacgcctgtaaacctagcactttgggaggtcgaggtgggtgaatcacttgaggtcaggagttcgagaccagcctggccaacatggtgaaaccccatccctactaaaaatacaaaaatattagccaggcatggtggtgcatgcctgtaaccccagctgcttgggaagctgaggcagaaaatcacttgaacccgggaggcagaggttgcagtgagccaagatcacgccactgcactccagcctgggcgacagagcaagactccgtctcaaaaaaaaaaaaaaaaaaaaaaaaaaaaaaagtttgaaacttaccctcattttcctgtcttcttctgagccctgtaaactcttccaaccactactcattacccagttccaaagctgtttccacattttcaggtatctttatagcaatgcccaacttctcggtaccaattttctgtattggggcattcttgcactgctataaagaaatacctcaaactgggtaatttacaaagaggtttaattggctcatggttctgcaggctttacaggaagcatggtgctggtatctgcttggcttctagggagacctcaggaagcttacagtcatggtggaaggtgaaggggtagcagacacatcacatggtaaaagcaggggcaagtgagagagctaaactcccgctttctgatcacatatcccaacctgctccaactccctaaatccttccactgtgtctacatggtagaatctcctacatccacaacttcttatgtcaactttccttctatttcttgatctaactcctcattctcaagctttttttttaaccatgacccacaataataaattttacatcaaaacaccatacgcacatacatacacacacatattatatgtgtatacacaactgaagtcccacaaaaacaaaccttactaaaataaagctatatcagatatgattttattaatagccaaataaacaaaaattcagaaatacaaagttccgtgaaagagttgtttacatgcactgtcaactgttctctcattcttatgttctctccctccaggattttacctcctccattccaccaacacagctcttatgagggtcaccaatgagctccacattgctaaattggtgaatacttctcagtcctcactttagttgacccattagcagcatgtgacctattggctttcacatggcccatcacccctcttcctcaaaacactgccttcatttggcttccagggcatccctcttgattttcctaactcaatgagagctcctccttagtctcctgcactgtttttcctcatatcctatctctaaccactgagagaaccccaaagttctcctctgacatcttctctatttgaatgcacttcctcagctatctcctctagttcaacagctttaaatttactaacttctacatttccatctctagcccagacctctcctctgaactatttttttattttataatatagacggggtctcactttgttgcccagtctggtcttgaactcctgggctcacatgattctcctgccttggcctcccaaagtgctgagattacaggcatgaggcattgcacctggcctggactctttattcacatccaacttctactaatgggcatctcaattttcacatgttcaaaacccaatttctttcctgccacaaaagtactccttatgcagacctccatctcattaaattctaactttatttttccagttgcataagccaaaaatctcggagttacacttgacactcctctttcatacaccacatgtaatcaatctactgaaaaatcctggtggctccacttggaaaatatactcagatccaaccaccactacccacactggctctaactagtcagcctgtttcctcccttcaaacctatggtgtattttcaacacagcaatcagaagtctctttctgtaagtcagatcatgctataccttgggttcaaaacctttccatggactcccagcttaaaaaagtaaatgctgaagaccttactatcgctgacatatggcctggcccttgactacctctcttagctccatctccttaatctctcctccttacttccactccagccacgattaactccttgttgttccccaaacatgttaaatacacttgtgtcttagggcctttctatttgttatctcccttgcctgggatactctccctctagttgtacctagaacagttgaatcatcgcataattgctaaaaggacaagtgaccatgtgacaacgttctttcatcttttatgcttgtaacaccagaatttacttgaaaaagtttgtaagtggacaagtatgaaagacagatatgtacacaaagtaacaggaaggtaaagatgatgtgaaaaatgaaaaccaatccactgaaagtcattctaattggtatttataaatgtaaaaacaaaaatgttttgctgttatgtaacaaagaatatagccatcatctatcacttcaacaaaactatgagccctaaagttttcagaagtattgcagtttggacaggtgtggtggctcatgcctaccgtccccagcactttggaaggcaggaagatcacttgaggccaggtgttcaaggccagcctgggcaacacagtgagaccctatttctacaaaaaataaaaataaattaaaaaacaaaaagtattgcattttgacaaagtgagttcatgaagaatacaaataataaggtagaacatagtagagatgcatttgaaatccaaaatccgtatttaaaggtaggtatgttccagattcatgcataatgacagctgctttcaaaggatgtaatgccttttaggtatacataaacattcaaaactgggaaaatatgggaaaaaatgtgggtctcctatatttggattctcattaaaattgctaacaaagttaattttcaccatccctttattcttctgtaaattgtttataaaatgacttgaaaaagaatgcagtcaattctcattacttgaggtagttatgttctatgaagttgccacaaacacgcaaattagtgaatactgagccattgctcctaacagaaatacagggttaggttcttgtaagcctttggtcacattttcaccaacttataaatacgtaagcttgttttatatctgtttctgtttaaagacacattatttaataaatatagacctggcatggtggctcatatctgtaatcccagcactctgggatgccaaggtgggtggatcacttgaggtcaggagttcaagactggcctacccaacatggtaaaaccccacctctactaaaaatacaaaaattacgctgggtgcagtggcgggtgcctataatcccagctactgggaagactgaggcaggagaatcgtttgaacccgggaggaggaggttgcagtgagccgagattatgccattgcactccagcctgggtgacagagtgagactccatctcaaaaaatataataataaatagtgatgactcatcatcatctaactcccactcaacagcactataactcatgactaaacaaaggttatctaacacatgtattctctaaggcacctcacagcccgcatgcaccttggaataccactatatagcacttcagcacaatgcttgggaatcactttaaacagtaaaatcacaaacagaaggcacaaaaatgtgaaaaatgtagaactatataaactgctttcaaaaaggacacttgtttatagtaagaaagctacacaaaaaactgagcactgttcaaccccagctgggaatatctgggtaaggttctcaaatttttcacctctgtgtatgtccatgaaaaaccatgaaactgccatgagtattgatgttaggttacaaataaattttagcaagtaggtgcctttacaaatacagattctacaaataaagagaattgactgtaaataaaattttataagcaaaaactctgaaaataaaaacaaatagttaaaatggtaatgggaagaccatataaacaacagaaaattaaaagttcttaaacacatgaaaaggtgctgaacttcacaataagataaaaatgtacaaatatgagataatcatttttaactattcaattgacaaagattcaaaggtttgataaattattggctattttgcaggaaacaaactctccatgttggtataaatatagattaatataacctctactgaaaacaatttagcaaacttttgtttaaaatttaaatgtaggtcgggcacggtggctcatgcctgtaatcccagcactttgggaggccaaggcgagcagatcacaaggtcaggagttcaagatcagcctggccaacatggtgaaaccccgtctctactaaaaaaatacaaaaattagccgggcatggtggcgtgtgcctgtaatcctagctactcaggaggctgaggcaggagcactgcttgaacctgggaggcggaggttgcggtgagctgagatcacgccattgcactccagcctgggcaacagagcaagactccgtatcaaaaaaaaaaaaaaaacaatttaaatgcaatagcctcttcaacacagtagttctaattctagatacttaatcctaaagatgctgactgtactattaaataacaaatgattagaaacaaattaaactctcatccacaagagctcaattcattaagcgtggtacacatctgtaagaatatcctgtaagtgcttaaaagaatgagagcttttttttaaatttttaatttttgcatttttcttattttattttattattatactttaagttttagggtacatgtgcacaatgtgcaggttagttacatatgtatacatgtgccatgctggtgtgctgcaccaattaactcctcatttagcattaggtatatctcctaatgctatccctccccactccccccaccccacaacagtcccaagagtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcatttcttatggttgcatagtattccatggtgtatatgtgccatattttcttaatccagtctatcattgttggacgtttgggttggttccaagtctttgctattgtgaatagtgccgcaataaacatacgtgtgcatgtgtcttcatagcagcatgatttatagtcctttgggtatatacccagtaatgggatggctgggtcaaatggtatttctagttctagatccctgaggaatcgccacactgacttccacagtggttgaagcagtttacagaactctccaccccacatcaacagaatatacatttttttcagcaccacaccacacctattccaaaattgaccacatagttggaagtaaagctctcctcagcaaacgtaaaagaacagaaattataacaaactgtctctcagaccacagtgcaatcaaactagaactcaggaataagaaactcactcaaaaccactcaactacatggaaactgaacaacctgctcctgaatgactactgggtacataacgaaatgaaggcagaaataaagatgttctttgaaaccaacgagaacaaagacacaacataccagaatttctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagagctgaaggaaatagagacacaaaaaacccttcaaaaaattaatccaggagctggtttttggaaaggatcaacaaaattgatagaccgctagcaagactaataaagaagaaaagagagaagaatcaaatagacgcaataaaaaatgataaaggggatatcaccaccgatcccacagaaatacaaactaccatcagagaatactataaacacttctacgcaaataaactagaaaatctagaagaaatggataaattcctcgacacatacaccctcccaagactaaaccaggaagaagttgaatctctaaatggaccaataacaggctctgaaattgtggcaataatcaatagcttaccaaccaaaaagagtccacgaccagatggattcacagccgaattctaccagaggtacaaggaggaactggtaccattccttctgaaattattccaatcaatagaaaaagagggaatcctccctaactcattttatgaggccagcatcatcctgataccaaagccaggcagagacacaaccaaaaaagagaattttagactaatatccttgatgaacattgatgcaaaaatcatcaataaaatactggcaaaccgaatccagcagcacatcaaaaagcttatccagcatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaattcaacaatccctcatgctaaaaactctcaataaatgaggtactgatgggacgtatctcaaaataataagagctatctatgacaaacccacagccaatatcatactgaatgggcaaaaactggaagcattccctttgaaaacacgcacaagacagggatgccctctctcaccactcctattcaacatagtgttggaagttctggccagggcaattaggcaggagaaagaaataacgggtattcaattaggaaaagaggaagccaaattgtccctgtttgcagattacatgattgtatatctagaaaaccccattgtctcagcccaaaatctccttaagctgataagcaacttcagcaaagtctcaggatacaaaatcaatgtacaaaaatcacaagcattcttatacagcaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataacgccgcatatctacaactatctgatctttgacaaacctgagaaaaacaagcaatggggaaaggattccctatttaataaatggtgctgggaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaacggcaacaaaagccaaaactgggatctaattaaactaaagagcttctgcacagcaaaagaaactaccatcagagtgaacaggcaacctacaaaatgggagaaaatttttgcaatctactcatctgacaaagggctaatatccagaatctacaatgaactcaaacaaatttacaagaaaaaaacagacaaccccatcaaaaagtgggcgaaggacatgaacagacacttctcaaaagaagacatttatgcagctaaaaaacacatgaaaaaatgctcaccatcactggccatcagagaaatgcaaatcaaaaccacaataagataccatctcacaccagttagaatggcaatcattaaaaagtcaggaaacaacgggtgctggagaggatgtggagaaataggaagaatgagagttttaaatactgatatggtgtgttctccaagatatattgacagaaaagcacttatctattgaagaacattatatgaattacctctaaagataaaaaattttaaaagttcaaaaagggtaatgatgatatatcatgacagaacttaattactttttttctttttgagacagtcactgagtcacccaggctggagtgtagtggcacgatcttggctcactgcaacctccgcctcctgggttcaagtgattctcatgcttcagcctctccagtagctgggatcacaggcgcccaccaccatgccgagctaattttttttttgtatttttagtagagatggggtttcaccatgttgggccaggctggtctcgaactaccgacctcaggtgatccacccacctcagcctctcaaagtgctaggattacaggtatgagccaccatgcctggccttaattacatgttttttaaaaattcacaataaatgtatacacaaacattttaaaaaacacaaaagggtacactgtgaaaagtgtacagaagggctgggcatggtgattcatgcctgtaatcctagcactttgggagcccgaggtgggagaatggcttgaacccaggaactcgagaccagcttgggcaacatagatcatgtcactaccaaaaaaaaaaaaaaaagtgtacagaagcagagttgctcttgttttttgtttgttgctttggtttggtttttttttttgagacagggtctcagtctgttgcccaggctgaagtgcaatggtgtgaacacggctcattacacagcctcaacctcctgtactcaagtgatccttttgcctcagcctctccagtagctgggactacaggcatgcaccaccatgccttgctaattctttcatgttttgtagagtcaggggttttgcgttgttgcttatgctggtcttgaactcctgggctcaagtgatccgcctgtctcgtcctcccaaaatgctgggattacaggtgtaagccaccgtgcctggcccagagttgctcttagtaacgtgttttttttttttttttttttgagacggagtctcgctttttagcccaggcttgagtacagtggcacaatctcggctcaccacaacctccacctcccgggttcaagcaattctcctgcctcagcctcccaagtagctgggactacagggcgtgccaccatgccgggctaatttttgtatttttagtagagacagggttttactatgttggccaggctggtctggaactcctgatctcaggtgatccacccgcctcggcctcccaaagtgctgggattacaggtgtgagctgccgcgcccagctgctcttagtaacttctggaatttgatgtctaaattgaatccattatttcaaacatcacaagacttaagttcataaaaacttttttaaaaagttaactctgggtcaggcgtagtggctcaagcttgtaatcccagcactttgggaggccgaggcaggtggattacctggggtcaggagttccagaccagcctggccaacgtggcgaaaccacgtctctactactaaaaatacaaaaattagccaggcatagtggcacatgcctgtagtcccagctgctcgggaggctgaggcaggagaattgcttgaacctgggaggcagaggttgcagtgagctgaaattgcgccactgcactccagcttgggtgagagttagactgtatcaaaaacaaaaagaaattaactctgtagtttatttctgttaatggcaaccctgcagaaaagttaaacttagaatatgtctcaaagtaatctctgtctgatcccttaatgaaggatctcttcaaacacagcaacttttgtctgtcttctgaatgtaggtacagctgtggctgtagaacagaccatgtaattttcatctagattccttacaaccacaaggacaattattacaatgaaagccagagaactagctcagttttgattttattactaggataaatccagccaggtagtgtggtggctttgatgttttctgtctatatctaagggggaagctgcttcattattcgatattaagataaatagggcctaaaaatagtcctaggtcaaacaccattatgattaactcaactttcaaaaccatttacctaatgtaggatttgttaataagtcttcttcaaaattagcaagaaatacaactaatgcctaacccgtcatgatgaattaaagactgatccaaaaataactgacagttctcttccagttgccctcttctttgacaatcccaccagtctatgctctaagctcacgcttgacttccaaaaactgccagatattgtagacaccatgaagaataagatgtactaccttttctctaatgaaagaggaaatacagatataaacaatatataaacataatataatgtgaaaagctatgtatagaaataaatagagaggccgtgtgcggtggctcacggctgtaatcccagcactttgggaggccagggtggtcgaatcacttgagggcaggagtttgagaccagcctggccaacatggtgaaactccatctctactaaaaatacaaaacttagtggggcatggtgccacatgcctgtaatcccaactactcacgtgggtgaggcacgagaactgcttgaacccggatagcagaggttgcagtgagctgagattgcaccactgcactccagcgtgggcagcagagcgagactctgtctcaaaaacaaacaaaaataagaatatgtaaagacatgaaaaatgtgacattaagtgggaatacacatgcacatacacaaaatgctatggtggcatccatatcaaaatatgggccaaagggcaaaataatatgcaaaaaagaaatacaatcacagatacagctaatttaaaaaaaaattaaatatttttattatatacttttaaacatatagaagatagaaaaaaacagtacaatgaacagccatgtccaccagttagattctgtaacattttgccacatacgcctcacatacattttgttaaaccatttgaaacattttaagacactctaacacttcattcctaaatgcttaagtatgcaaattaagacagtcttttataaactacaacacccttctcacagctcataaaattaccaataattatccaatatcattcaaaatctaatccacattcaaattttctcaactgcctcaccaccgtgctggcctcccacccccacctcagtcttttacagatggtttttcaaaatagagtccagtaaaatatttcacattgcatttggttattacataacttttaatcaagaagagttacccattccacttccttttttctttcccaacacttgatattttgaagaaatgaggccagttatcttctataacgcttcacattccagatctgtctgatcgtttctttagtggtgtcatttagtgctgctctatgccagcatttcctgcaaatgagaaattagaaccagaggcttgacgaattccagttaaaccatgtcctctgtggacaccagttaaacttgactagagcacttcatatgtcagagtgtacagtgcagtatgcctaggttatcccatatcacaataaaaaaaagtctgctggtctgcctactagtgatataaaatggcatcatatcctaaagctctttattgtgaaagtatgtttcttccacacaaccaaccagttaagtatgagaattctagtagggatgtagattaaccttttatctaatagttttggcatcaaaattctttaatattgattgttttacattaacctttcaactttctaacatctgaactttttaaatgttcaaaaacatttgttttccacaaaccataaagttttacaaaagtaagattcactttcataatgctggcagacttactccttaatttaaggaatgtgagcaccttccttctttttgattttgtctaaaaccctgtaaggaaaataaaggaagttaaaaaaaatagctatatagatatagatagctatatatagatagctttatatggatgttaaaaagcattttgtttcacaagacattttacttattttattcaacaaaatatgatcagaaattaagttgatagtcttttaatgtactttaaaagttatcccaaagaaaacaattattaggctgcagttaaggttttcttgcagtggctcatgcctacaatcccacaactttgggaggcggaggtagggggatcacttgagacctggagcttgacaccaccctgggcaacataatgagaccctgtctctacaaaaaatttaaaaattaggccggcgtggtggctcaggctaggcacagtggctcacgcctgtaatcccagcactttgggaggccgagacagttggatcacctgagctcaggagttcgagaacagcctggccaacatggcaaaaccccgtttctactgaaagtacaaaaaattagccaggcatggtggtggggacctctaatcccagctacttgggaggttgaggcaggagaatcacttgaacccaggaggcggaggctgcagtgagctgagatttacaccactgcactccagcctgggtgacagagcaagactctgtctcaaaaaaaaataaataaataaaaataaaaattagccaggtgcagtggcattatcactgtagtcccagctactcgggaaactgaggtgagaggactgcttgagccctggaggtcaaggctgcagtgagctgtgaatgtgcccttgcactccagcctgagcaatagagtgagacctggtctctaaaaaataaaatttaaatgtaaaaaatttaaaaacattgccggtcacagtggctcatgcctgtaatgccttgccttgcacttttggaggccaaggcgggcggatcacctgaggtcggatttggagaacagcctgaccaacatggagaaatcccgactctactaaaaatacaagactaggccgggcacagtggctcacgcctataatcccagcacttggggaggctgaggcgggtggatcaaaaggtcaggagatcgagaccatcctggctaacacagtgaaaccccatctctactaaaaacacaaaaaaattagccgggtgtggtggcgggcacctgtagtcccagctactcgggaggctgaggcaagagaatggtgtgaacctgggaggcagagcttgcagtgagccaagatcgcgccgctgcactccagcttgggggacagagcaagacaccctctcaaaaaaaaaaaacaaaaaacaaaacaaaacacaaaactggctgggcgtggtggcatatggctgtaatcacagctactcgggaagctgaggcaggagaatcacttgaacccaggaggcggaggttgcagtgagccgagattgcaccattgcaccccagcctgggtgacagggcaaaactccatcttaaaaaataaataaactaattaatttaaaaaaatatttttcttccttttttttttgagacggagtttcgctcttgttgcccaggctggagtgcaatggtgcaatcttggctcaccgcaacctccgccttctcggttcaagcaattctcctgcctcagcctcccaagtagctgggattacaggcatgcgccaccatgcccggctagttttgtatttttagtagagacagggtttctccatgttggtcaggctgatctggaactcccgacttcaggtgattcgcctgccttggcctcccaaagtgttgggattaccggcgtgagccactgcgcccagctgatttttcttctttcagtatgtccaatgatgttcctgagcccgcttataccttatttttttttttttgagatggagttttgctcttgttgcccaggctggagtgcaatgaggtgatctcggctcaccgcaacctccacctcccaggttcaagcaattctcctgcctcagcctcctgagtagctgggattacaggcatgcaccaccacgcccgcctaattttgtattttttttagtagagacggggtttctccatgttgaggctagtctctaactcccgacctcaggtgatccgcctgcctcggcctcccaaagtgctgggattacaggtgtgagccaccgtgcccggcctataccttattttcatcaaataaaatatatgaccttaaactacctgtgtcatacttattaaaatgagaccattaaacaccagtattcactaaataaaaaaaaaatttaaagtcaaaaattaatactaaaacatttgtttttcttgtcagatctagcccaaatgtcctctgtctctcttctggcttcaatgctttctatctttccctacatgtatactagcttgcagtggcttcccacttcattactaatctacacctaacagaccgtaagatgtattgaaagatttgttactaatgagtatcaaagttataacctattttatgttatttcaacaacattattcttagtcatttgcattctgcttagatttctaagacaaaaagatagaggttaaaagctagactcagagcctatctcaaccacgtggcttcagtagaacaaaggttaagaattgttagcttaaggcaatgacgtattaaaaacacttaaggccaggtgcagtggctcacgcctgtaatcccagcactttgggaggcctaggcaggcagatcacgaggtcaggagatcgagaccatcctggctaacacggtgaaaccccatctctactaaaaatacaaaaaattagccgtgcatggtggcacacgcctgtagtcccagctacttgtcgggctgaggcaggagaatggtgtgaacccgggaggcagagcttgcagtaagccaagatcatgccactgcactccagcttaggagacagagcaagactgtctcaaaaacaaaaacaaaacaaaaaaaacccaaaaaaccaaaaaaacaaaaagaacacaaacgaatgttcatagcaacattattcattatagcccaaaaataaaaacaacctaaatgtccatgaactgatgaatggataaaatgtgatataaccaaacaacagaatattcagcaataagaaggaatgcagtactggtgcattctacagcatggatgaatcttgaaaatagcatgctaagtgaaagaagccagacacaaaagaccacatatcgtataattccgtttatatataatatctaaaatagacaaattcatagagacagaaagtgtactgactgcctagggctggggaaaatgaaggtaacagggtttctttttggggtgatgaaaatgttcttaaattgtagtgatggttgcataactgaaaaccaaaaccactgacttgtatactttcttttttattttattttttgagacagagtctcgctctgtcgcccaggctggagtgcactggcacaatctcggctcactgcaagctccacctcctgggttcacgccactctcctgcctcagcctcccgagcagctgggacaaaaggtgcccgccaacatgcccggctaatttgtttttgtacttttagtagagacggggtttcaccatgttagccaggatggtctcgatctcctgacctcgtgatccacctgccctggcctcccaaagtgctgggattacaggcgtgagccattgtgcccagccaacttgtatactttcaaaggtaaactgcacaccatgtgaattatttctcaagaaagttatttagaacataaattataccaatactttatatatacattatgtatttttttcaaatatttcataatttaaaaaacacaaaagcctacagtgttacagtcagataactgatctcaaaacaaattacaagctgttgatttattactttttggtcattaaaatgaggaattcatgatacatacaatataccaaggttatactacaacaactgaagcgtgacttttttttccctccgcaaattctcactctgttggccaggctagagtgcagcggtgtgatctcggctcactgcaacctctgcctcccaggttcaagtgattctcctgcctcaacctctcaagtagctgggattacaactgcccgccactgggctaagttttgtgtatttagtagaaatggagtagtcaccatgttggccaggctggtcctgaactcctaacctcaagtgatccacctgcctctacctcccaaagtactgggattataggtgtgagccaccgtgccaggcctttttctttttttgagatggaatctcactctgtcaccaagggtggagtgcagtggcacaatctcaactcactgcaacctctgcctcccagattaaagcaattttcctgccacagcctcccaagtagctcggattacaggcatgtgccaccatgcctggctaaattttttttggtatttttagtagagacaaggtttcatcatgttggccaggctggtctcaaactcctgacctcaagtgatctgcctgcctcggcctcacaaactgttgggattacagttgtaagccaccatgtctggccttaacttttaaataagaatattaatgggggcacacacagatgatacatttaaaaacatacacctttaagtcagttgtttcttctatattaatttactaaaaatacaagtgcctacaatatcacatcataattttagcagggcacaagagcttacttttaaaaataattttaggccgggcgcggtggctcacgcttgtaatcccagcactttgggaggccgaggcgggtggatcacgaggtcaggagatcgagaccacggtgaaaccccgtctctactaaaaataaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccgtctcaaaaaaaaaaaaaaaataaaataaaataaaataattttaaatgttctgactaaaatacaatagaacatgtccgtaggagactaacgtataaagtgacaagtttgaagccatactccccaaggttcaatgtggtacacattaccccagatctttgtgcattaaaaaaatttcatttctcttggaaggccgaggcgggtggatcacggggtcaggagattgagaccatcctggctaacacagtgaaaccctgtctttacaaaaaaatacaaaaaattagacaggcgtggtggcaggcacctgtagtcccagctacctctgaggctgaggcaggagaatggcgtgaatccaggaggcagagcttgctgtgagccaagatcacgccattgcactccagcctgggcaacagagcaagactccgtctcaaaaaaaaaaaaaaaaaaaaaagaatttcatttttcatttatgaaaaattatcccatcttttccattccctacaatcaatttcaaatcagagattaaaacattatttagaaaaagtataatttcaattcaaaagtgtataatcaaaataatctaacaatagcatgaaagctttttaaaattaactaaaattatacttagggacaatgcaagagtaatttaagcctcagacagttgtatttttttatttttattttttagtaatataaagagagaagcaagtagtattttataaatttacaaaacaaagtcacataactacaaaaaaattgtcaggaaaagatgctgagtgattacttaccatataatagccagtatgatagccactcatgtaccatgaaattaacatacttcccaaagcatcagcatcatcaagagaatctggacatatgggaggtggtgggggaattatctggagacagaaaaagatattgtttatatccagtaaacaaaaaagtaaagtctggagatttatattatatagtgaatgctggaaattaattgtatttttgcttatataatctcctacttaaatttcttttttttcccctaaacaaagacgaggtcttgctatgttgcccagactggtctcaaactcctgagctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagcaagtgacataaaaagtttaaacattttgatttagactatgtatctgttccactatgaagctatgagtaaaaaaaaaaaatcaagcataaatactttcatgcttttccttaatacacacacacacacacacacacacacagctcacatagcatttcgagggcgattttaagtaaatgtcttgggtagaacacctgttctaaccccatcccaatacacagtatgccaaaaagtatctttttatctattgttaatacctaaaaatctaccattagaaatccagtttacagctgggtgcggcagctcacgcctgtaatcccagcgctttgggaggccaaggcgggtggatcacctgaggtcaggagttcaagatcagtctggccaacatggtgaaaccccatctctactaataaaacaaaaattagccgggtgtggtggcagtcgcctgtaatcccagctacttgggaggccgaggcagaattgcttgaacccaggaggcggaggttgctgtgagctgagatcacaccactgcactccagcctggggtacaagggcaaaactctgcctccaaaacaaaaaaaaaaaaagagagagaaagaaaaagaaatccagtttacatcagaagctaacatccaactatacctagaagggcaaacactaattccttatataaggtataattaaatcccttctaacaggaactacctccttatggcatagacaccaacttctgccaggaaagaaggcaacctagagcttagacttgggactacaagagcactgcatctgggtaacagaaaggcattaaaaacaaacaaaacccagaggtttagttcaaatttctacccattagaatctggcccaagggatgttctacaatgacattttacaatcctctattctgctaattatcaaattgtatgtgaaagcaaaatctaacctatactcttttttacttactggtggtccagaaggaaatggaggcagccagcatgatagtaagtggggtggtggtggtggcggtggcggtggtgggccattgaattttagacctggctataaggaatatttcaaaggaaaattaacttaccaatttcaatatgataggaataaaaaggactcaaaaccaaaaggataaaaataattacccagaatatttgttttatacatatcaaaaagattaagtgaaatttcatgtaccaaatcctgaagtcaaacagactcataagtcaaatgacaacctctggatttttctcatttcctttctatgtagacattaaggaagtaaaacaaaataagagtggtgattacctaataaatcagagacagtctatttagcaaaattatttcaatcataaaagactatatcccaaatttcattaactaaattgtatatttttatgaaagcctgtttagctatacatgccaacttagaggacatattgtgaaaactagcaaatctctccttataaaaatcagccccctgagaccaatgaagcatgatgtatatattctaagagggtacatcattttagattcaagaaactgtaatataatgtaagcctcaataagaacattatcacagaaaatcttaaaacttttggtgagtcatgcttgttttttgaaaatgactgcctaggctaggcgcctgtaatcctagcactttggaaggccaaggtggggagatcacttgaggtcaggagttcaagaccagcctggccaacatggtgaaaccccatctctactaaaaatacaaaataagccgggtgtggtggcgggtgcctgtaatctcagctacttgggaggctgaagcaggagaatcacttgaacccaggaggtggaagttgcagtgagctgaaatggtgccactgcactccagcctgagcgacagagcaagactccatctcgaaaaaaaaaaaaaaattgcctaaataccattccctccatggaagaaatcaccgctttacacaaaagaactagaaagggacaagccttaaggttccatgacataatctaacctataataaaaatctttttagagttgatttctgttacttataaccaaaaggaccataaatgaaaacaatatttacatttgaactctacaaaacaatctgagagcgcctcaggattttatctatattagatgtaaataatgtgttcttattttacatatcttatacaggtgacatgggaaacaacagcatatcatccagctaatgataaattattattacacttttttttgttttgttttgtttttttgtttgagatggagtctcattctgtcgcccaggttggagtgcagtggcacgatcttgactcactgcaagctctgcctccggggttcacaccatcctcctgcctcagcctcccgagtagctgggactacaggtgcccgccatcacgcccggcaaatttttttgtattttcagtagagatggggtttcaccgtgttagccaggatggtctcgatctcctgaccttgtgatccgcccaccttggcctcccaaagtgctgggattacaggcgtgagctaccgcgtccggcgcattattatactttctaacttaagtaagtgtgctaattattagtctaatacctaatactccacaaaagttaactggataaatctttcatataaagtattttgttgcatccactgcagtgtctaacatttttttaaaaaattaactattttgcatcattatcttatttccttttcaaaaaattcttgtgtatttaagctacaaaagtttcatgggagagctacaaattagttaacagagaggttaaatgtcccgacattaactattttctggaaaactttcatagaaggtttacctttcctggtcccagtcttggccctggcatggggggtggtggagggagaaaagagttccatggagcagatttgggcttgatgttatctgatttatttccaggagacctggagttctcactttcatctgttgaaacttggctttcattttcattctttaaaaagaaaaaatatgcaggtttttgttataagggtgtgattaagaaaaaattaatgcctcggtggatcaaactgacaactgtgtatactgtttaacagtttctcatctagtctctgcttccagaaattgaatttttttttttttgtatccttacctcttgagcattttgttctatattattagctacttcacagattggggaaagtagatcggacagattttgctcctctctatttccatatccagtgtaaaccacaacacaggtttctctcttaaaatcaattgaagcaatggtagctgggtaaatgcaaccgtcttctgaccaaatggcagaacatttgtccccaactttccactacaaaagaaatcaaagatatatacatgcacacatttcttttgaagagggcaaactatcatctcgttttgatcagtggggaggtgaaggatagagggtagagatttggaaggcaaaatgatgtaatgagaaaggcttggggtctaaatacataaatctgaattccaactctcttacatttataatcatggacaagtttctgaatctctttgagtcttagtttccccatcttattagatggctataatataaactacctcccatatttgttgtgaatagcgggagggagataaaatgcgtatggtgcccagcactctggactggcctagagcaagtgctcatcaactgttagctctcttcccccttggtaatgatgaaactaaagttggctcaaaagacaccaaaatattcagctttcaggactactgcttttaactagcagaaataatctacctagacttctgggttccttggaattaacagttttagagtttttaaagaaaaaggggaaaaaaaaatctatctctcagcttaagatgtaaaacactgccaattcagcttacggctcttgggtactccttccaaacggcaccttctccctgccttccattcacaaatggaacacatgtcctgattttagcatttatcattcccatctaattctttatactttcatgactaatatgcatgttcctaaataacagaaaatttaatagttgtttttgaagttgtataagtatatgtcaatagaaacactgtactaatcacttaagttaaagacattttacactattaaataaggactaatgagacatcctttgaagttaaatctcaacattttaaaataacctgttgtaaggaagctgcagtattcttcttttggcttttattcttcttagcaggttttcttttaggtgtggtttttggtttacccgaagtttcacaaatgtcaccattctttagagcatgctacgaaaataggaataaaaatgtacatgttacagggtggtgcacagaataaaagtcacgacataacccagttactactataagctagtctcaaggctccgtcacctcagaaagcacctattttctcttttgaccaccccctgcactataaaaactgctcttaaaggcatcatacacctgacatcagctctaaagacccttttaatcaaatctccttgctctcaacctctctgtaacattagaccctgttaattatctttcttcctgatattcatggccctttggatgtcatagcaatgtagggccccaacggtttcattacttctgatcaagccttagatttaggcattcccaataagagctggccatccttctttacttgcttacggccattattttatttattttatttttttacacagagtctcactctgtcaccgggctggagtgcagtcacactgatctcagctcactgcaacctccacctcccaggttcaagcgattctcctgtctcagcctcccgagtagctgggattacaggcgtgcaccactgtgcacagctaatttttgtatttttaataaagacggggtttcaccatgtgggccaggctggtcttgaactcctgacctcgtgatttgctcgcctcagcctcccaaagtactgggattacaggcgtgagccaccgcgcccggccaaggccatctattcttattactttagttgcaactgtctgcaaacacacttctgaagctattaatccagctgtgacttttctcaatctaacatttccaatgatcaatttcacatcttaattcatacctcaaactcaacctcaacttaattcatattcaacctcaacttaattcaaattcaatctcaacttaattcatactcaaactcactactaaaactatcgttttcccaaatcagttcttttcctcctttactcagattacttctccctgcaatatcaccaacccatcccacatcgagccccatttcaatctctattttatagaattctcttggtaattctttagtcgacttctagtttcagtgtatactggaaagcacatttaaaaatctaggccgggtgcagtggttcatgcttgtaatcccagcactttggaaggtcaaggcggagggatcttttgagctcaggagttccaggccagcgtgggcaacagggtgagactgcatctctacaaagaatacaaaaatgagctgggtgtggtggcacacacctgtggtcccaactactcaggaagctgaggtaggaggattgtttgagctcatgagttgaaggctccaatgaggcatgatcacgccactacactccagcctgggtgacagggcaagaccccatctcaaaaaaaaaaaaaaatctagaaatcagttacaaaggtgacatagaggtctgatctttagctcatgttacaagagtaactatgagaaagacatgaaatctgtatgcttggtgctctttatacactgtatgagtatatgctctgtttgctcaaggtagtctggactattgtttgctcaaggtagtctggactattgatgacccatatttagtgctcagtaagactaaacatctcagagaatggagaaggtgatgatgttggccaactgtgtaagtgtcctgtttgagacacagaaccatactacatttcctaaaagaactgtatattcctacccaataggaacacttgaattgatacccaacttacaggatttgggatgattagagtaatttaatatatgaaacgcacacagagcactgtcagcatgctacaaatattaattgctgtactaatgctatttatcttcatcattattttactacatgcttgttaaatgtttaaaattataattcagattgtctttttcttattaatctcaattagaggacttccatagtttgatacaatgtaaaaatactaaaaggaatacattgtttgttcgttttctgagatggagtctcactctatcgcccaggctggagtgcagtggtgcaatcattgcaacctctgccccccaggttcaagcaattctcctgcctcagtgtcccaagcagctgggattacaggcacgtgccaccatgcttggctaatttttgtatttttagtaaagacggggtttcaccatgttggccaggctggtctcaaactcctgacctcaggtgatccacccgcctcagcctctcaaagtgctgggattacaggagtgagccaccatacccagccaggaataaatgttttaaattttatttaaattgcctccacaaaggatgacatatataggctatcaacttctaaaggaggatatcacctgatttaactaactcatactaccatctaatcttcaaaatgaaaactgaataacatgtactttaacactttatcgtatgttatcaattcctttccaaatgaataacgagaaaataagaaaacgactaagcaagcatttcataccttaaatgaagccacagctttatcatatgcttttatcagtgctgtatcatcccaaatgtcagaatcatcgctctggaaagggtaagaaataaaaacaactcatgttcagataggtttaatcagaaaatgtatgttagtaccaagagtcatcttaatccacacataacaaaattacactgaaaatgagtatttaaaatcctaaataaagccacaggaaacttacctggttagaggttatgtgactttactccaaaagctagacataggtaaatgttctaagaatgaatgccatcaagtgaatgcccctacaatttaattcctatccacataccatgagtagatttgttcaaggccagctatatttatttcaattaagatcagataaaacttgacttcatctagactacgggaatgctgttctgacctcagaacctatgatccaaagaatattttttcttttgaaattataatgtttccagattataaggatacaaattgttaatagtgactaaccaattttcattttattattattattatttttttacttccatttccctttcctgctttcctggtaccaattttctttccttccttttcttttcctttctttcgtttctttcttctctccctccctccttcctttcttccttccttcacttctctttctctcttctttttttctcccctcaaattcctgtgttcaaatgaccctcccacctcagcccactgagtagttgggaatataggtgcatgccaccatgcctggctagtttttaaaattttttgtagggacggggtctcgccatcttagccaagctggtcttgaactcctaggctcaagtgatcctccagcctcgctcggcctcccaagtgtgggaattacaggcatgagccactgcacctggaaatatttttgtccagacatggtggctcatgcctgtaatcccagctacttgggaagctgaggcaggagaattacatgagcccagttgttggaggctgcagtaagctatgatcatcccattgccctctagcctgggtgacagaggaagaccctgtctaacaacaacaacaacaataacaaaataataataataataaataattttttagcactatctgctagcactgtgcaagtcactgagagatatatagaaacatggtactctccagttattatctaactagggatttaagactatcacacaagacaaaacaaaaaacaatataaaacaaatcttaacaaacatcaaaatgtgaaatacaaacagtattttaattaaaaaggaaagaaattaatgtctactgcaagatcatatggaggaaaccggcctaagaaataaaaaccactcacgcctgtaatcccagcactttgggtggccgaggtgggtggatcacgaggtcaggagttcgagaccagcctggccaacatggtgaaaccctgtctctactaaaaatacaaaaattagccggacatagtagcacatgcctgtaatcccagctacttgggaggctgaggcaggagaatcacttgaacctgggaggcagaggtggcagtgagccaagatcgcgccactgcactacagcctgagagacatagcgagactctgtctcaaaaaacaaacaaaacaaaacaaaacaaaataaaacaaaacaaaacaacaggatttaggccgggcatggtggcttgtaatcccagcattttgggaggccaaggcaggtgaattgcttgagtccaggacttccagaccagcctaggcaacagggtaagaaccttgtgtctactaaaaatacaaaaattctggccgggcgtggtggctcatgcctgtaattccagcactttgggaggcagaagcaggcagatcacgaggtcaggagttcgagaccagcatggccaacaaggtgaaaccccatctctactaaaactacaaaacttagctggcgtggtggcagtcacctgtaatcccagctgcttgggaggctgaggcaggagaatcacttgaacccgggcggcagagattgcagtgagctgagattgtgccactgcactccagcctgggtgacagagtgagactctgtctcaaaaacaaacaaacaaaaaaaccaaatttagctgggcatggtggcacatgcctatagtcccagctacctgcaggggctgaggcgagaggatcacctgggcccaggaagttgaggatgcagtgagtggagatggcgccgctgcactccagcctgggtaacaaattgagaccttgtctgggaaaaaaaaacaaaaaaaaacaaaaaaaacccccaaaaaaaaaaaaaacccaacaggatgtgcataggtagacaaaatagaacgcattccaagtaagagcatgaacaacaacaaaaaaggcatggaagcaaaaataacactaactataagaatttatttatgtaaggtaactaagtagtcaaatttatagaattagaaagaatgggccaggcgcagtggctcacgcctgtaatcccagcactttgggaggccgaggtgggcagatcacctgaggtcaggagttcgagaccagcctcaacatggagaaaccccttctctactaaaaatacaaaattagccgggcgtggtggtgcatgactgtaatcccagctactcgggaggctgaggtagaattgcttgaacctgggaggcggaggttgtggtgagtcgagattgcaccattgcactccagcctgggcaacaagagtaaaactccatctcaaaaaaaaaaaaaaaagaatgatgattaccaagggctaagtgtaaggagaaatgggaatttgctaatgggtagagtttcaggttgcaagacgaaaaacttccgaagatctattgcgcaacaacatgaacatacttaatattactgaactatatacttaaaaatggttaaaatgacaaatttttttacttcaataaaaaataaaacacactgtatgagggattagtgagacaagtccaaatagaatccaatttatactatagggtagagttggatttggtatactagagagtattttggatttggtatagtattagtcaatgaattccaaaaaagtttgttataaaattcactgagttgtaatattactttttgtcattttcctgttttttttttgttttgttttgttttctcttgagacaagagtctcgctatgccacccaggctggagtgcagtggcatgatctcggctcactgcaacctctgctgcccaggttcaagtgattctcctgcctcagtctctcaaatagctgggattataggcgcccaccatcaagctgggctaatttttgtatttttagtagacatgggctttcatcatcttggcaaaactggtctcgaactcctgacctcaagtgatcctcccacctcagcctcccaaagtgctgggattacaggcatgagccaccgcacccaggcttgtcattttcctgttaatctccgttatatagagacaaatgtattccaatataaaatgtcaatcttgctgtatgataaaaagtacttaataatcccagcctgggcaacatggcaaaaccccatctctacaaaaagtacaaaaattagctgggcgtggtggttcacatctgtagtcccagctacccagaaggctaaggtgggagggccgcttgaaccagggaagaggagattgcagtgagtggagatcagagatcgtgccactgcactccagccagggtgacagtgagaccctgtctcaaaaaaaaaaagtacttaagatcattaagtcactttgcagataagaaaagtaatcacaaagaggttaactgacttaaggttacattcgcacttggaagggaagatattccttggagatttggtaaaaggaataaaaacaggctgggtccagtggctcacacctataatctctgtctcgaaagaaaaaaaggggggtaggggggaggctgggcacggcagctcattcctgtaatcccagcactttgggatgcagaggtgggtggggtgggtggatcacttgacatcaggagtttgagaccagcctgccaatgtggcaaaaccccgtctctattaaaaatacaaaacttagccgggcatggtggtgcacacctgtagtcccagatacttgggaggctgaggcaggagaattgctggaacccgggaggcagaggttgcaatgagccaagatcactgcactccagcctgagtgacagagtgagactccatctcaaaaaaaaaggaagcaaacagtagaaaatgaagggtggtcctgaagaaataaagaaatcacaaaatcaaggccagtgatatcaatagaagagtgcagtcttaaagcaagatacatagacagatggcagctcaaactcctcatatctcaactgttattgccagaccaggaaacaagtaatttcaaaacgaacagaaaacaaagcgacagaagaaaaggtaatactgattacaaggtacccaaggacaaatacatctgactgaaaatctaaggagcaccaaagcaaagccatgaaaaagaaccaaaggaacaaaaataaataagaagcaaaatggttgatacattggcaaacagtatttatttaacgtatgtataaatggggtccctgaagaataaaaacaaaacaaaacaaacaatcttcctggtggtctagtgattaggaatttaaaaaaaagaaaaattcctagggatgggaggaagaaccccctcccatcctcagagagcctctaagcaaaaagactaagttacaaaataaagaaaatcagttatcattagactttctcatagaaatttatggggaaaaagtatgagccaagaattttatatgcagcctagctgtccttgaagtagcaagactaagaaaagtctaaaatgtagaagaataccgtactcactagcctttccagggtaatctattgaaaatacgcttcatccaaccaagatatgaccagggaaacttgggttttaaaaataacagaactggccaggcatggtggttcacgcctgtaatcccaacactttgggaggccgaggtgggtggatcacctgaggtcaggagttcaagaccagcctgatcaacatggtgaaaccccgtctctactaaaaatacaaaattagccgggcgtggtggcgcatgcctgtaatcccagctactcgggaggctgaggcagaagaattgcttgaacctgggaggtggaggttgtggtgagccaagatcgcgccactgcactccagcctgggcaacaagagcgaaactcttgtctcaaaaaaaaaaaacgaaaaacataaaacagaattgttagcatcaaatatatttaattgtggatctaagaggaaagtagtgtattaaattgaaaagctgattctaaaatttatatggaactactaaggacaaaaataaaccaaagctggacaatttacattatctaactttaagactgtaaaccagaagtagctaagacaggtttcaatcaatttagaaagtttattttgccaaagttaaagacgctcctatgacacagccacaggaggtcctgatgacatgtccccaaggtggtggggtacagctttgttttatacattttagggagacatgaggcatcaatcaatatatgtaagatgtacatgagttctgtcaggaaaggcaggacaactcaaagtgggggtagggaggtttctaggtcataggaagatttaaagattttctaattggcaactagttgaaagagttattatcaacagaaaggaatgtttgggttaccataaggggttgtggagaccaaggttttatcatgcagatgaagctcccaggtagcaggcttcagagagggtaggttgtaaatgtttcttttcagactttaagagtctgttctatcagtaattccaaaaggtagtagggtgtgatgagacatgtccaactcccccttcccatcatggcttgaactagtttttcaggttaattttggaatgcccttggctgagaggatgggtccattcagttggttgtgcaggggcggggggggcctataattttatttttggtttacaagacataccctgaagcaatagtaattaaaagtgtagtactgacatcaatatacactaatagacaatgtaacagaattgagagtcagaaatagccctgtgatatatgtgactgattttaactaaagttacaaatgtggtttaatagagaaagcatagtagtttcaagaaatggtggtaaaactattggaaatccttatgcaaaaacaaaccaaatttccacctacactgagccacatataagaattaatacaaaatggattacagacctaagtgtaaaactaaaactctaaactgtgtaaaaaaaaaaaagagagaaaaatctgtgatcatggattgcctataacaaaagaacaaactgaaatggccttgttgcctggggtggcacccgaggttcttggtctcacgctgaggaaatcaaggacgctgacacaccaagggtgtgaggctagagcagaagtttaataggcaaaagaaagagactagctctctcctgcagagagaggtcctgaaaagagttcccattccacagtgaaatgcaagcatttttataaatgagctaatgggaagggggtagcttatctacacatagggagcaaaaaaccagttaggaccaggtgttgccatctgcacagagcgtgaatctctggcatcccccaccccaaccttttattatgcaggcaggtccttggcctgagctactccacattgcttatctctttcctattgtgcatgtgctaaataaggggaggtggagccaccatggtggacatgcctggccccaggtacccctttctctccgtgcagctgcaggcaaccccaacaactcacaacatgcaagcttccagcttccttatctgagtatgtactaaggtccactgtgtttacttcacatactgtgtttacttcacatacccaccttacgtatgtgaagcttgctgattacccaggaagctccccctctgtgccagagctgcttccttatacatgtttacagcccgatcttccaggctgctccttgttagaagagaagtgatttcttgggctgctttttgttagaagggaagttctaccgaggactctgtctaactatcggcttacctagtctttttttacctcctctctcaaaaccatcaaagaaaaaactgaaaaattagatttcagcaaaattaagattttctgttcttaaaaagacgttgttaacaaaatgaaaaaccaaagtgtaaaccgggagaaaatacatgcaagttacctatctgataaagatattgtacccagcaaacatgaagaactctcaaacctcaacaacaaaaaaattcaattaaaagatgggtaagttggccgggtgcagtggctcatacttgcaatcccaatctttgggaggctgaggcaggaagattgcttgagcccaggagttcacgacaagcccaggcaacataatgagaccttgtttctacaaaattttaaaaaattagccaggcattgtggcgtgtgctcgtaatttcagctactcagaaggctgagacaagaagactgagcgcaggaggtggaggctgcagtaggctgtgtgattgcaccactgcacaacagcctgggtgacagagtgagacactgtctccaaaaaaaaaaaacaaaaaaaaaaaaaacccaaatgatttgaatagacacttcaccaaaaaagatatacggatggcaaatacactcatgaaatgatcaacagcagcactggtcattaggaaatgctaattaaaatcacaagaagccactatatctattataatgcctaaaattaaaaagactgaccataccaggtgtttgcagggacactgagcaaatggaactttcatacattgctggtcaaaatgcaaaatgggggagctgttctgaacctatttagttgtgggggctgtccaacttttgaatttttctttgctcaattaatctctgttatattaaaaagtaacatggtacaaccaccactttgaggaagagtttgacagctccttaaagacttaaaatacatctaccctgagacctaagtattcactcaagaaaaatgaaagcgtatgtctatacaaagtcttctttaaaattttttatagaaaatttttaatttttgattttaaaataaaaatagaggtttcaccatgtttcccaggctggtctcaaactcctgggctcaagcgatctgccagccttggctatatgaagtcttatacactaatattcatagtggctctacttgttaacagtcccaaactggaaaaagcccaaatgttcacaagcaagcgaatgaatacagtatagtatatacatgcaatgggatactactcagcaataaaatggatgaaaatcaaaatagctatgataaataaaagaaacgtgacaaaaaaggtactctatcattccacgtttataaaaattcttaaaaatgcaggctaatctatggtgacagaaagtagatcagtggttgtctggggacaggacaaggagggatgaaaaggatcacaaaacagcaatccaactgaggccaccatgctataaggaaatccaaaccagcccacacattgaaaccacataaagaaatcttcatgagactacatgaaaaaaagagatagcctgccaatccctagctgctcagtccccagctactgtagctctagcaactatgtaggtgcaaccacgagacagccgcacgaaaactgcccagcacggctctcacaaattcctaacccacagaaacaatgagagataataaaatgttctttgttgtttcaagccactaagttttggcagattcgttacacagcaacggcagccagaacggaccaccaggactgcctttatatctgattctcagtcatttccagtagctcagatttctcaaattattcccaacaccctgccatcttctaccttctcctaccacttcctgaaacttccactgtgctcccttgagtaattcataaaatccactcttttaacctctgaatcatcccttcatttcttgctctaagtaaaatctagctccctgaggatgccttttcctttcgcagccatctcaaatgatagatgtttcctcttttctcctccacacacttcatatcactgtacctactggagatgtggggaagaaatcttccctgctctggctggcgcggtggctcacgcctgtaatcccaagcgctttgggaggccggggtgggcggatcacaaagtcaggagattgagaccatcctggctaacacggtgaaaccccgtctctactaaaaatacaaaaaaacaattagctgggcgtggtggcgggcgcctgtagtcccagctactcgggaggctgaaggaggagaatggcgtgaacacgggaggcggagcttgcagtgagcggagatctcgccactgcactccagcctgggcgactgagccagactccgactcaaaaaaaaaaaaaaaaaagaaaaaagaaatcttccctgctccttacttgcactttcagattattctcctccattcccctctcaaaattcccagccttgaaaatcctgacaaaaagtagccaggcatggtggtcagcacctgtagttccagctacttgagaggctgaagtgggagaatcccttgagcttgggaggaggttgtagtgagccgtgatcgcgccactgcactcccacctgggcaacaaaaagaggccctgtctcggggggggggaaaaaaagaaagaaggaaaatcttgtcaccagactcacagtctattatcgtttcctattgcagtcacctacagcctaccgagtcactcttcctcattccttaatgtttacatcgcagttctctctccaacactactcctgtcataatttttggtgatttaaatatccatgtagatgatcccttcaattaccctatatttgcaggtctctaaactcctctccaccacaatcttgtacatcctctgatgtggtgcagctctgtgttcctacccaaatctcatgctgaattgtgatccccagtgttggaggtgggcatggtaggaggcgactggatcatgggggtgatttctaatgatttagcaccatccccaagtgctgtttcctgataagcgttctcacaagatctggttgttttaaagtatgtagcacttcccccttctctctctctcctgctggccatgtgaagactgtgcttgtttccccttcaccttccaccatgactgtaagtttccttaggcctccacaagagaagcctgtacaggcagcagaactgtgagctgattaaacctcttatctttataaatacctggtctcaggtatgtctttgtagcagtgtaagaatgaactgatacatccccaaatctcagctactcactcacttcaactgtatttatttattataaccaataaccacaacctctccataaatgcagtttcaagaatcccactctcttaaccatcaccttctaggctctgcaacttactcctactagtgatttgatggggacaatcattccacttcattaggactggcagtacattgatcctcccacttttttttttttttttttttgaggcagagtctcattttgtcgcccaggatggagtacagtggcacgatctcgggtcactgcaaactccacatcccgggttcaagtgattttcctgcctcagcctccctagtagctgagactacaggcacctgccaccatgcccagctaattttttttttccaagaggagtcctgctctgtcgcccaggctggagtgcagtggcgcaatctcggctcactgcaaacctcgcctcccgtgttcaactgattctcctgcctcagcctcccaagtagctgggattataggcacgcgccaccacgcccggctaatttttgtattctttttttttttttttttttaaagacaaagttttgctcttgttgcccaggctggagtgcaatggagtgatctcagctgtctgcaacctctgcctcccaggttcaagcaatttttctgcctcagcctcccgagtagctgggattatagacacgtgacaccatgcccggctaatttttgtatttttagtagagacaaggtttcaccatattggccaggctggtctcgaactcctgaccttgtgatctgcccaactcggcctcccaaagtgctgggattacaggtgtcagccacagcgcccggccgatcctcccactttttaaactgtctctcagggtcttaaaatcctcacttcctttctttttttttttttttgaggtgaagtctcactatatcgtccaggctggagtacagtggcgtgatctcggctcactgcaacctccacctcctgggtccaagggatactcctgccacagcctcttgagtagctgggattacaggcacctgccaccattcccggctaatttttctgtatttttattagagatggggtttcgccatatcggccaggttggtctcaaactcctgacctcaggtaatccacccacctcagtctcccaaagtgctgggattacaggcgtgagccaccgcgcccggcctctcacttcctttcttagccagcttaaattccatggtcaatcattaagagaactcctttgtacttctccccctcacttcttcatatccacgtggtaaaatcacaactgcattaatttcaactctccatttactctgtgggtgccctcatacacaatcttgctgtctggtctccttcaactcatgaccacgaatctcaagtaggctctttatgttgcctagcaatatttccactaaacttccctagtccaacccttgcccactcttctaaagaactatctacttcccatcttctctttcctctcccatcccagcttctagctgataaccttgcttctttcactaagagaacagtaagaatcaagagaactttcaaaatctcctgccatcctatctgcccattcacgtatcatagatgtgttaactatatagctgtcaccaaaagaaccgctaatgtttccaacaaaggccaaatccatcccttcttacctactctaggacattgctctagccattgtcttctttccgacatcaactttcccattctcatctttcctatcaacccacaaacatgctgaaacatgttgctcctatcttagtgcagtggctcacactagtaatcccagtactttgggaggcagaggtgggaggatagcttgaggccaggagtccaaggctgtagtgattcatgattgcgccactggcaccccagcagcctgggcaacagagcaagacccccctcttttaaaaccacacacacataattaaaattcctcttaactcacttccccctccatttattgcccaatttctctaccctccatttataataaaatttcgtggtggctcactcctttaggcccagcgactccaaaggagggtcgcttgaggccaagagatcaacgctgccatgggctaggatcatgccactgtactccagcctgggccacagagagcgaacttgtctctaaaaaaattttttttaaatagaattccttgaaatatgcctaccgatgtttttattatttatttatttatttatttatttatttgagacggagtcttgctctatcgcccaggctggagtgcagtggcgcgatctcggctcactgcaagctccgcctcccggcttcatgacattctcctgcctcagcctcccgagtagctgggactacaggcgcccgtcaccacgcccggctaattttttgtatttgtagtagagacggggtttcaccgtgttagccaggatggtctcgatctcctgaccttgtgatccggccgcctcggcctcccaaagtgctgggattacaggcttgagccaccgcgcccggccgtttattttgttttaagacagggtctggctctgtcgcccaggctggagtgcagaggcgcaatcacagatcactgcagcctccacctccctgagccttccaaggcctgaaccttccaggtagctgagaccacagacgcgcaccacaacacccgtctaatttttgcagactcggagtcacactatgttgcccaggctggtcaaatgttgccttggatttctcttctcctactctccaactcactccagccaaattcacccctaccatgctatgcccaagactgaactcctgagaaacctgctctactggcaatcttctctttcccacctcagcaaaaggcaactttatcttttcaactattcaggataacctccgttatcgaatctatctgaaaaacctgttgcctccgatttcaaaatatacccagaatccaaatactttcactctgttaataacatcttgttctgaagttcagatcatcttaacagactcctaagtggttcccctgcttcaccctggcctaatgcccccacctcccccacaccagccagagaggagtgaacaaaataagctactgccaagtcgcggcagggcctccactcaacgctatcaaggagcccaaactgctcgaggaaggagcttgcggatgtggttcgcagggaacggagtgggaaaagacgtagaaaaacgcggaccacaactccagtgagcggatcgacttgatgctgtcccgaggctgcggaaggagagttgggccggaagaagggtgctgagagcgctaatagggagactgcactggctgcgacctcacctggcctgtgccgcgccggaacagcacggaatcctcctgctccgggacgccgccaccactgccgccgctgctcatcgccatagcaaacccgcgggtgcgcagcgtggggccccgtcccttcttaagagtgacgacttccgccgcccggggcttctgggagcggaacagtacggtggccgggaggaccgcttgtagtaacttctcacgctttctacgagtggttatcgccctcccacatttgtggcgtgtatatttttcatttctctcaatcctttcatttcactgtgttatatttcctttccttttttttttgtttgtttgttttgagacagagcctcgccctgtcgctcaggctggagtgcagcggcgcgatctcggctcactgcagcctcgacttcttgggctcaagcgatcctcccacctcagcctccccagtagctaggactataggcgtgcgccaccaagctcagctattttttgtatttagtagagacggggtttcggcatgttgcttaggcctcgtctcgaactccagtgtgtgtgtgtgtgtgtgtgtgtgtgtgtgtgtgtagatatttattccccctcccccttggaaaagtaaatgtaagctcctactaggaatttaaaacctgcttgatctatataaagacaaacaaggaaagacaaacatgggggcaggaaggaaggcagatccttaaacactagaagatatttgatcccccaaccttatttgttgtttgttttgagacggagtctcgctctgtcgtcagagtgcagtggcaccatctcggctcattgcagcctcgacctcccgagctcaagcgatcctcccgcctcaacctcccaagtagctaggaccacaggggcacgccaccacacccggctagtttctgtatgttttgtagaggcggcgtttggagcatattgtgtaggctggtctcgaactcctgagctcaagatattccgcccgcctctggcatcccaaaatgctgggattacaggtgtgagccacctcgcccagcctccagtattcttttttttttttgcgacagagtattgctctgtcacccaggctggaatgcagtggcgtgatctcagctcactgcaacctctgcctcccaggttcaagcaattctgcctcagccccccgagtagctgggattacaggcgcccaccaccacacccggctaatttttgtatttttagtaaagatggggtttcaccatgttggccaggctggtcttgaactcctgacctcgtaatccgaccgcctcggcctcccaaagtgctgggattacaggtgtgagccaccacaccgggcctccagtattctttattaagcatctagggttgctaaatggcttatatgtacatagtatatatatatttttaactccacgaaaggaactttgagctcttcccccaaaatacccttggcttctatatagtatacaagaaatatctgtggaggaaggggagaatgggatgatgttgaccaagtgtacaaaaatggtaactctgtagaggtaatatgtggaatgtaatcatttcacaatgtatatctaaacatcaaatggtacaccttaaatatatacaatttttaggggtctggtacggtggctcatgcctataatcccagcactttgggaggccaaggtgggtggatcacttgaggtcaggacttcaagaccagcctggccaacatggtgaaaccctgtttctcctaaaaatacaaaaatcagccgggtgtggtggtgcaggcctgtaatgacagctgcttgggaggctgagccaggagaatcacttgaactcgggaggcggaggttgcagtgagccaagatcacgccactgcactccagcctgagtgacagagtgcgactccatctcaaacaaataaatatgtacaatttttatgtgtcaaaaaagttaaattgtcacaagataaaaaaaaaaatttaaatctcatgtcaggaaagtaatgtgccaaaggtacatctcacagataaacatgaaaacctgccctccagcctgggcgacagagtgaggctgtgtctcagaaaaaaaaaaaaaagtaaaaaaaaaagtatgtttttataaagcttgcttagatttttctgaatcataaaaattctcacaattgcatttgatgtcaaaatttaaacaaattacctggacatattacatgatggttaaaaaaataaatttaaacaaaatatagaaccaggtttctttttgttttttaatttttttctttttgagacggagtctcgctctgccacccagactggagtgcagtggctcactgcaacctctgcctcccgggttcaagtgattctcctgtctcagcttcccgagtacctgggattacaggcgtgtgccaccacacccagctaatttttgtatttttagtagagactgggttttgccatgttggtcaggttggtctcaaactcctgaccttgtgatccgcccgcctcagcctcccaaagtgctgcgattacaggcatgagccaccgcacccagccatttctttttgtttttattatttagagatataattgatatactatagaattaatcgttttagagagtacaattgaatggtagatagagcggaaaccttaatatattcacaaggttgtgcaaccatcactactatctaactccagaacattttaatcacccaccaaagaaactctgtttcctttaacagtgcgctgccatgctcagctattttttgggagagaaggggtctccccatgttgtccacgctggtctcaaactcggttgcttaagcagtcctcccacttgagccgctgtgcccaggcctgagttactatatttataaaagttatttcatatgatagacaaatcattcaaaacataatgaggtaaactgccaaaagaaaccattttaccatatttgaaggcatttaatgtaaatgttgaatttaatttcatgtactggaatcagtctttttgcatatgtaattttcataccaaaaatctctcttcagttgactcctggaactctctcatgataaaataaaagtttcaaataatgtcggggtggtggctaacacctgtaatcccagcactgtgggagtccgaggcaggtggatcacatgaggtcaggagtttgagaccagcctagccaacatggcaacactaaagatatgaaagtcagccaggcatggtggtgcatgcctgtaatctcagctactagggaggctgaggcacaaaaatcacttgaaactgggaggtggaggttgcaatgagctgagatcgtgccactgcacaccagcctgtgagacagagcaagactgtgtctcaaaaaaaaaaaaaaaaaaaaaaaaaaaaaaaaaaaaaaggggccaagtatggtggctcatgcctgtaatcctagcactttgggaggctgagtgggagaggatcatttgagcccaagtaacatggtcaggccccatctctacaaaaataaattagctgggcatggtggtatgggcttgtggtaccagctactcaggaggctgagacaggaggagtacttgagccaaggaggtcaaaggctgcagtaagccatgtttttgccaccgtgctccagcctgggcaacagagcaatatgctgtttcaaaaacaaactaaaaaaatggtagtacctacatgtgaagattgcatataataaagattgtaaagcagagagaaaaactggacagttcaccaaaaagaaaatccaaatgtccactagagatctgagaagatgcccaacctctagagccaaggaattgcaaattaataactaagataacatttcagggcctggcacggtggctcatgccagtaatcccagcactttgggaggctgaggcaggcggatcacttgaggtcaggatttgagatcaccctggccaacatggtgaaatcctgtctctactaaaaatacaaaaattagctgagcatggttgcggcgcctataatcctagctactttgaagactgaggcaggagaatcgcttgaacctaggaagcggaggttgcagtgagctgagatcgtgccagtgcactccagtctgagtgacagggtgagacttcatctcaaaaaaaaaacaaaaaaacaaaaaatttcaggaatatacctgcctttggtaaaaacaaaaagaaattgtgaaccaggcgtggtgactcatgcctgtaatcctagcactttgggaggctgaggcaggaggatcctttgagcccaggggtacaagaccagcctgggcaacatagggagaccttgtctcaaaaaaaaataaataaataaataaaataaaaaataaaaaaatcgtgaatagtgttgcgatgaataaaaaagaaaaaaaattaaaaagaaagaaaacccagaaaaactaacataccattttcctctcagtttggcaaaactattaggaattaataacatttgatgttagcaaagtatggggaaatgaacttttatcctcttattgaaaatatctgtttgtagccaggcatgatgacttatgcctgtaatcccagcaatttgggaggccaaggtgggaagattccttgaggccagaagtttgagaccagcctgagtaataaagtaagaccccatgtcattaaaaaaaaaaaaaaaaaaaaaaaaaagaaggaaagactgccgggcgcagtggctcacgcctgtaatcccagcactttcagaggctgaggtgagcagaacacttgatgtcaggagttcaagaccagcctggccaacatggtgaaaccccaccccatctctactaaaaatacaaaaattagctgggcgtggtggcgggcgcctgtaatcccagctattcaggaggctgaggctggagaatcacttgaccctggaggcggaggttgcagtgagccgagatcacaccactacactccagcttggacaacagagtgagactccgtctcaaaaacaacaacaacaaaacccaaaacatctgtttaaagtttaagacatgtatacctgtgaaagttgattacataaattgggtcattcttgaaatactcaactaaatcagagttgaagggccagggggaagaagcattcggggcacacagcatctgcttcaagaattaaattttccacaagtccaactgctgaaccagccttctgtatccctaagaccagttttacctaatagctgctaaaatgaactgccatgactctaagactggttttacctaccaccatcgctcaccaatcagagcttgctagctcccacaagctctagtgtgaatgagctttcttccaaaacagtatgtaatactgttctttctcataaaacccggaaccttctcttttttttttttgagatggaattttgctcttgttgcccaggctggagtgcaatggcgcgatctcggctcactgcaaccttcacctcccgggttcaagcatttctcctgtgtcagcctcctgagtagctgggattcaggcatgcgccactatgcccaactaattttgtatttttagtagagacggagtttctccatgttggtcaggctggtctcaaactcctgacctcaggtgatctgcccgcctcggcctcccaaagtgctgggattacaggcatgagctatcacacctggccgcaaccttccctttattctcctgatcataccaatgatcagcccggtctgtgtgtatgccatgaattgcagctcttgcttaccaaataaaatgtttttagagatttgtctctatattatatttggctttgacataactattcccaaggaattctatctttaaaaatccattcttatagaaatgaaagcaccaataaatgggaataagtacgataatccacatcgcagaattgtttgtagtggcaaaagttgcaacatcctaattgtctatgagtaaggaaatgattgaataaattactgtacatctatactaaagttaaatttgtaagtactgaagtacaggcacggctattttttttttctttttgtggaaacagggtctcactctgtcacccaggctggagtgcagcggcaccatcttgggtcactgcaacctctgcctcctgagttcaagtgatcctcacacctcagcctcccaagtagctgggactacaggcacgtgccaccacacctggctaattttggtttttggcttctttcttaattggtatgtttacttaaaaatatagactaatgggctgggcatggtgacttacacctataatcccagcactttgggaggccaaggcgggtggatcatgaggtcaggagatcgagaccatcctggctaaaacagtgaaaccccatctctactaaaagtacaaaaaattagccgggtgtggtggtgggcacctgtagtcccagctactcgggaggctgaggcaggagaatggcgtgaacctgggaagcagagcttgcagtgagccgagattgtgccactgcactccagcctgggcgacagagcaagactccatctcaaaaataaataaataaataaataaaataataaaataaaatatagactaatgatcctgtgcttcaatgtcattgtggttatgtgctgatgtccataaaacataagttataagggactcttcacaaatacactccagacagaagggtaaacagaaatgactgacaagacagtgccatttcagacatacttcccttaattattaatacttgctagaaaatggagtttgacattatttacaattataccaatattcacagaggccaactgtcacaggcattaagggcacaccagggccaggagacctcatttcagacttcccaaatatttttatattttagctattaagatcagttaccagagctcaacttgttcttaacaagcagaatttttatgtccattcaaagagtctcttatacctttctgggcctatttacttgcagagaacagtagaaactgtaaccaggctcttcatatcatgcattcacatgtgatgtccaatcttcatatgctgtccaatttctttaagataaatggagtgactcgcagcagggccacgtagatgagaaagttctgtatggagatcatatcctcgtgcatcttccgtttcatctccgtgaggtccagcttccgggcaaggcccccaatccggaagatcagctgcctcgctctgctctccctaatggcccccttacacccggaactcggcctatcccctcgccccagctaatttttgtatttttagtagaaatggggtttcgccatgttgcccaggctggtcttgaactcctgggcacaagggatctacccgccttggtctcccaaagtgctcagattacaggcatgagccaccacgcctggcccaacatggctattattttttaaagtgctaaattatggccgggggctgtgactcacgcctgtaatcccagcactttgggaggccgaggcgggtgaatcacgaggtcaggagatggagaccagcctggccaacatggtgaaaccccatctctactaagaatacaaaaaattagctgggcgtggtggcaggcgcctgtaatcccatctactcaggaagctgaggctggagaatcgcttgaacccgggaggcggaggttgcagtgagcagagatcacgccactgcagtccagcctgggcaacagtgcgagactctgtctcaaaaaaaaaataaataaattacctgggtgtggcagcgcgtgcctgtaatcccagctacccaggaggctgaggcaagagaactgcttgaacccaggaggcagaggttgcatggagctgagatggcgccactgcactccagtctggtgacagagtgagactccatctcaaaaaaaaaaaaaaaaagtgctaagttacatctaagtttcctatttttgtttaaaaaactccttgtagtgggttgaatggtggaccccaaaatgatacatctgtccatctgatatgcgtgaatgtgacctatttgggaaaacagtttttgtagatgaaattaaggatttccaaatgagatcatcctaggttagaatggaacctaaatccaacagcaaaagtcctcataaaaagaagggaagaagacagaaaagaagaccacaaagacaaaggcagagataggagttatgctgccataagccaagtaatacctggagccaccagcagctggaagaggaaagcaaggattctcccttggagccttcagagggaggtgtggcccagctgacatcttgctctcagatttctggcctccagaactgtgaacagaaatatttctgttgttttaagccactaagtttgtggtaatttgttacagcagctctcagaatcaaatacattcccacaccccttatttatgtgtatgtgtgtgtatgcatgtttgcatgagcactgagagaagtataccattattaacattggttagttcaggggaatgggactggcttactgaaggctgagagagtatacgtgtgtgtatataaattgagtgtatttaaattaagtatatggaagtaaattaagactacaatgagataccactacctcccaccaatatggttaaagataaaaggactgataatacctaatgctggtatggagcaatggaaccttcctttattgctggtggtaaaatggtatggtcattaaaaacaaactaaaacaaaaacaacaaaaatgcaattgtttgatggtacctactaaaaaatgtgtgtatgtgtgtgtatagacacacaccctatgacccagcaattccattcctggcatatactcagtagatagcgtgtttaagaccatcataagatatataaaaatgttacggtagcattattcataacagccccaaagtgggagcaattcaaaggtccatgaaatgtagagtaactaaattatggtatattcatataacagaatgctacacaacagtgaaaaaggctgaactgctgcatagcagcaaaatagagaattcttttagacgtaacgttgagcaaatcaagctaggctcactacagcacataccgtgtgatcccatttacaaaaaattcaaaaacaggcaaaactaatctatggtgataatcagatgggaggcattatctaagagggtgctggaaatgtcctttattgtgatctgaacatagtattcatatacgagtcattgaaatatacatttcaaatgctggctgtttattatcatttcactgggataaatgcccaaggagttagttttcaaagagatgctatttagaatttatggaaatttagaacttactgtattttcccagattttctataatgagcaagcattgcagtttgagggtttgaaagattggtagagacaaaaactgcataagctgcatgattatttctcacacttcagatgcttaccacctttatgatttgccatatcatgtattttaaaaaatacatttttttctttttttagatggagtctcattctgtcacccaggctgcagtgcagtggtgtgatctcagctcactgcaacctcctgggttcaagtgactctccggcctctgcctcccgagtagctgagattacaggcacccatcacaatacctggcaaatttttgtatttaaaaatacagccaggctcggtggctcacgcctgtaatcccagcactttgggaggccaaggctggcggatcacctgaggtcaggagttcgagaccagcctgaccaacatggtgaaaccccgtctctacttaaaatacagaattagctgggcgtggtggctcatgtctgtaatcccagcactttgggaggccaaggtgggtagattgcctgaggtcagttcgagaccagcctgaccaatatggtgaaacctcatctctactaaaaatacaaaaattagctgggcatggtggtatgctcctgtagtcccagctactcaggaggctgaggtgggagaattgtttgaattcgggaggtggatgttgcagtgagctgagatcgcgccactgcactccagccgggcgacagagcgacactccgtctcaaaaaaacaaaaacatacaattttaaaaatttagtcttagcttttcaataagagggattaaaatatattattttagtctgctcagcatccattctcccttccttttggcaaagaaccctaaattttttgggggatgatatagtttggctgtgtccccaacccaaatctcatcctgaattgtagctcctataattcccatgtgtcatgggagggacctggtgggaggtaattgaatcatgggggtggttaccttcatgctgttctcatgatagtgagtgagttctcaggagatctgatggtttcataaggggcttttccccttttgctttgcacttctccttcctgccatcatgtgaagaaggatgtatttgcttccccttctgccatgattgtaagcttcctgaggcctccccagccatacacaactgtgagtcaattaaacctctttcctttataaattatccagtctcgagtatgtctttattatcagcatgagaacggactaatacaggggaccacctactccttactagagttggttttaccatcaacttgccctcctcttgctgagggatgggtacctaacccatgtaacttcagttggaggcactccaagtgacataaaaactaaatatacatgtcagaagttcaacctgatatcagcactgtaagaaaaaaaaacaaaaacaaacacctcataacacctactcttaagatacctgaaactgttacaattcttgacctttccaaagccttgagtcctcaacttttccatgactctggagtctctcattctttcaaataagatttttatcagtaagttcattaatctgatcctgttgcttgcaaccaaaaattccaatatatcatgaaatcaggttagatgtggttatattacttcaagtatatactaacccatttcccgtttgccccaagaatactcttgcctctaatcctaatgtaacattatatacatttccattatattaggattagagacaagttctgtttagaaataactctaagaacagtttgtgtattttcacattgaaaattaatttgcgtcaacctcagagtgtgtttatgtaaaattaaatgagcgctggcagccagctgcactttttttttctttttttctttttttttttttgagacggagtctcactctgtcgcccaggctggagtgcatggagtgcagtggcatgatctcggctcactgcaagctccgcctctcgggtctatgcctttctcctgcctcagcctcccgagtagctgggactacaggcgcctgccaccatgcccggctaatgttttgtatttttagtagagacggggtttcaccatgttagccaggacggtctcgatctcctgacctcgtgatccacccacctcggcctcccaaagtgctaggattacaggcgtgagccacggcgcctggccacttttattttctaaacaggaaatgggttaaatacgtaactctgtatgaaatatccattcataagctaccctaacagcccccttgagtggtataaggctacagtctttgaccaaaaaaaaaagtatttgacaaaaacttatgtcatgtgatatatgttcataaaaggcaagtatttaataggattatgtcaattatagccaggctggtaggtaaatttcttttaaataccaaggctcagccagactgctgcaaggaagtgttccagaacttatgtaccagcaagcagtcttgtccaagtggtaaaacagcaagagtagtatgtggaatggaaattcggtttgtatgtttttttttttgttttttttttgagacagagtcttgttctgttgctcaggctagagtgcagtggtgcagtctcggctcactgcaacctttgcctcccagagtcaagaaattctcttgcctcagcctcccaagtagttgggattacaggcgcccaccaccacgcttggctaatttttgtatttttagtagagacggggtttcaccatgttggccaggctggtcttgaactcctgacctcaggtgatctgcccacctcagcctcagcctcccaaagtgctggattataggcatgagccaccatgcccggccttgttttttatttatttatttctttgagatgaagtcttgctctgtcacccagactggagtgcagtggtgcaatctcggctcactgaaatctccacctcccgggttcaagcgattctcctgcctcagcctcccaagtagctggtattacagg

SEQ ID NO: 6 - DNA, 24970 bp, Homo sapiens
tctaactgctaacacatattctgatcaagccagaagtttatgtgatttaatatatctgtgtagtttaactagaaacgtatatatgtagtttgggccatttttatttctgtaactaaattgtggggcaaaaaatatgatttgccaatgtaaaaattttttcctttaagttactaaccaagaagctaggtaagataagaaatgaccaaacaaaaataatgataagaaggacagctattatatgataaactttagacttgaaaattaggtaataaagttaatttcttcagaatatcctaaaatgtaagtttgtaaattgataaagttcagaaaaacttatccatcttctactcatcaagatagcaaagtaagtttttcacaaaattaagactgagagttacgttattttttttgaagtggtaatcttgctctcatctaatttttaaatacagaaataaaaagatccctttgaattaatttcaagtagttttaatacctctcttaaagtaaccccttcagttctgtcacatttatatacacccaactttgaagcctattaagaatatctttgacatgtgagtaccctaacagtggctctggtttcttaagcacaaagggaaaatggcagggtttaatttctttggtgtacatatataaatagatgtttcaaataaaattaattgggtaaatgtgaatatggtttgaaccagccagagtatgataaacttttaaaaaatttttcctcagtgatcagccaggggaaaaaatatatgtacagagctcctgcccctctgcccccttataacttagcttttgcctctggttttgcagcaggatgtgtgttggtgggtttggggttccttctgtcttcggatgtaacagtcatgttagcaacaatattttgcagttacttcaccatcctcagcataatctgcctctctctcaatcttaatacagacaaataggtatgtctataaatgcgttcatatagtgtcaaggtagggaagactataaaaacttcagatcaggaaaaaaatatctcttaagagagtgtcttaaacattttaaattgctaggcaatttaaatctctctaatctgaatattcaccttttggtggaaagagccagtaatattggttttcttccactaaaaagtttcttcaaaatttttttttttttttttttttttttttttttgccgatatcttttacaggcccacctaatctttaaaaaaaagagaagaaacaattttaggcctgtataacatcctatttactacttcaagctccacaaatgtagttaatatatttgtttaagagagactttactcttaaatgttttaactttgcctacttaatggagttggatgtccagtgttggaaacagtcagtgtctgtttggtggctcgtgtttatttttgtcactgtagaagtgatctgctctggagtaatttgctgtatgcttattactttccacctttagcgttttgtgtactaatgctatgtactgctcctatatttatatatacatatatatatatatatacacatatatattatcagagtaatcttgctttggactgttgctctaaaactatgaatatgatgtagagactactacagctgcagtgaatgttaaggagtcaattcccatggtttagtttagtctcgggctggaagtctacatcttttgacctcttttgttttatatgatgctttttattatgtaggcactgccatccctgaatattccttgtaaagatgcagtgaagaagtcaatttaaaaggaagacaaagccaccgctgtctgtaaactgtaaatgtgtattttggcacttgtactccagtattctgaaaatagagttatgatggaaatgctgacagatccttaatggtggccagagctaccatgcagtgcaaaaataaattaagtgaaaatgtattattgagattaacagtgcaaggccaatacattttataaatctgtcagtatctttttaatggactgtgtatgtgtagttatgttgaaagatacattgtgtatgtgtacatgcttttgtgtgaattcaaggcacactgtaagatgtatttcccttctctaaaatccatgttgaaatgtaagtacagattgatagaaataggtgttttacttaaactcatataatctgtttcagcaccttttttaaaatgtataattgtactgatttgctgagagtcatttgaccaaagtttggctttattttgcatacaggaaaaattagcccctagccttttctcaagaagtgatgctgtttctaaagaagaatagatggggagatctgagacatccagagagaggacaatgtgtccaaaaccagctgaaggcagagagtccatgcctcattcattttaggagtccctcatgtctaacaccatcttctgtgtcctaaagccagtatatatataatatttttaaaactctgcaaagattggaacaagaagtggtgggatacattttttggcataaactgggctatgtgtgcccggtattttttctttcccccctatttctttggagggttttgttcagaaacaatgtgctatagccagagagagtcgatcttacaaagtccctgcatttactttcacagcaagaactgctaccttgattagacaggaaggagaacaactactacaacaaagagaataaaatacattcagtttggtaaataaccaaggaattggatgtgatgctcttacttaatagtaaggagatttacatcaaatttgagaaactgactttatcttcattcaggctgacaagccatttaggggattagaggggactgctttgtctcttatcaacccgaaactgagtttaggtgtggaagcatcagtcccagatgggttggggtggcagtagaactttctaatgaccatacttggattggactaatctgttcccttgttgtggcatagatactcaattttatttaaaataatggccttacaccttctccactgtatagaaagggtcaagatcagccccaggccctgctgaagcacactcacccaggggtgcactgcaccacatggttttccccaataatttgtttcctgtctctccaatttatggccccatttcgatatgcaaggaaacctggagagagatgacagataaccaagcctgacccccagacctctctggttgctaattcagggaaataagtctccaaaactagtggtcttgttttattctgattagtagaacaactaagggtattttattggtttccttgccagggataccacccaaatagaaaacacggagcacatttcaaagcttctgctttctctgccaggtaatagtatccataccttcctgtttatgcggtccccttctgtagaggcgtttccaattttttccagaggttgttaaattgcctttggctctcagcttagcctcttggtcttaatttccccttaattaaagaagggtaaccaatgtggtccctaggagctagtgagagaaatatacggcacaaaccagaaaacactctgataatgataactgggccctatggctcttaaataacagcacaaatagtcttcgacctgaatgagaaggctccttgagtccacttttataacaattcagggtgactactagggcactcggcagtccgcatggaatgggaggtgcccacaaggagtgggagatagatggtgagtaaagacaacgttatttgctcattttccccttaatcatgtagtcatgtctcccaccccatgcagtccccaccacagagttctgaggcttcaaaagggtagaaaaggataaatccaggccattaaaagaaaataatcaaagctattgaaaagataaaacaaatgagtcgcactaaaagggccgtctgtgcaagtaacaaggttgaaatactgatactgatttcctagccgaacagcattcctcacacatgtggtttgtgtatccgtgtctgggtgggtggtctggtgagaagtgctaaacgcagcaagatggcttagtttttgagcagtggagggaagctttgggacaggctcagcccgtggcatctatagtccctgcaacataaagaggctttccttttgctttgttccaggatggaaagttttaacttggcttattcatttaaatgtgagtctctattctgcacagaaccaatcagagggtaggagtgtgtgtgtgtgtgtgtgtgtgtgtgtgtgtgtgtgtgtgtgtgtgtctgtgtgtgtgtatgaaccttcttgtctctcgccaccccagccctaggggatgggatgtgtggcatagaatgtataactcttcatttgttggaatgtattccctgggtgctaagcacctattaacatctcttttgaaagggacgctgttttaaataacacctcggtctagctaggacaggaaatagcattaaattaaaggtacacacgaatacggtccacaagcaatctaaataaaggtggactcccccaaaagcacatctatactaatgagaatgccaaatgaagcgcgcttagttcaaaggcggagacttcttaagggaagcttcttttattcaggaaacacgatgcccgacgatggcttttgagagacacaaatcattgccaactcacatctgaagacaggctgcttcatgaatatccctcagaattgttagatgtcgggagttttgactttgaatcagttgggggataaatcattgttttccaaattacaatacttatttgtttccatgtttattatctgtctcccccactagaacagaagcacctgagggcaagaagtttggtttgttcactgctgattccaggacctagaacaagtccaagacatacgagacacctctatttatcaaatgaaaatgtgggagcattttgtggaacatgaacctcttttgacatttcatgagaaatggttttgcgtttaagtttggaaaaattgcccagtatatgaccctcttggcaattcatgacgtactaaaatattaaatcttggaaagccacatgttccaccaatagtcaaacttgtttaactttatttaatgcaatatttcccaaacagtatgtaacacaatagtagttatgcaagataataatagctgtttggcatttaaaataatgtttctttatcaaaatagtttttattttattttattgtttttttatgagacggagtctggctcagtcacccaggctggagtgcagtggcgcgatctcggctcactgcaagtaccacctgccgtgttcacgccattctcctgcctcagcctcccaagtagctgggactacaggtgcccgccaccacgcctggctaattttttgttgtatttttagtacagacggggtttcaccgtgttagccaggatggtcttgatctcctgaccttgtgatccgcctgcctctgcctcccaaagtgctgaaattacaggcctgagccaccgcgcccagcctcaaaatcgtttttaaactgtatttcattcttcaaggtttataacatagtttgggtagcacagtttcagagaaggacaacacggctattactatctctagaagtggttttctggattagctaaccatgtaactttttggccaaactggaattttttttttttttttttttttttttttacatacaggatttctctacgttgccagggctgtagtgcagtagctattcacaggcacataataacatgctatggtcttgaactcctaggcttaagtgaacctcccgctttggtctcagaagtagttgggactacaggtccataccactagatctggcaaactggaacatttttgagaaggaaatgggacactattaataatcatcccaggacaacatgaataaatcaaagctgtctttggcaaatcagggcatgtggtcactgtagtttcgaggaaaacactttgggacatgtggaactgaaagtataccttcagatttctctttccatcacttttatcatatgcacttatgatgcatatggtttggttgggctgtgtagggtagaaaaaatatctttcttcacccattgcaaggttcatggctgacacccctacattaaaaatagattaacaagagagaagcagagcagattcaaccaaagttttgtgtgacatgggagccattagaaatgaaggtccaagagacccagaggaagctccatttttatgcttaactttgatgaagaatggacagtcgtacggaagtatccataaaggcggtatgacctaatggtaataaactgggggcacttagcaaggcctgattgttcagattcttctgacctcagggtatagggcaggactcctttggaatgaggatctttttgacctcctttcaggtgaggtaagtcagaaattttttagaaggactctcgccttgttgaccaggctggagtgcagtggcctgatcttggctcactgcaacctccgcctcccggattcaagtgattctcctgcctcaacctcctgaatagctgggattacaggcgtctgccaccacgcccggctaactttttgtatttttagtagagacgaggtttcaccatgttggccaggctggtgttgaactcctgacctcaggtgatccacctgcctcggcctcccaaagtgctgggattacaagcatgagccaccacgcccagcacagaaaaatttttaaatgaccaatcttcatgggagaaatgtggcaaaaagagtgctctttctgcttctgagttttgtcagtttccttcagtttaaaatactcagtatgccaaggtgccatattttgggatattgtgttctgaaccttgacagctgctgctttgtggtaacaattgagcatctccctcatattaagggtaggcccacaggatccagggtttaaagggcgttgtcagtgttgctgaagaggctttgcaggtgatgtggtctccaagccagcccttccttcctcacccccgcccttgtgttagcctatcagttgaacaggtgaataggccggtattgaacatcagtcctgcaaggaagaagggcgcattccatatttggggtctctggccccatttcctgagcctgttgcatgttgaggttgtgtttgttttcctcaaacttgacacctttgtttgagatgctacctcttcattgtcacctgccaagtcattctggctgccgctgccatgtccagggtggaattgctcagctggcaggtcctctccctgttagagcatgttctggaactttgtaggttttcactgtgtctccaagtcctactacctgataccctttgatattttggtgattccaagtcgtatgggcacaattcctagcgtagaccaaatgctcaaaaaatgatgaaccgattaaataaatggccgtaaataaatatcttccttggcttgcaagtaagttgctaccttgatgccaattctctgctgcctctttccttaaaagtgtgtcttattctgctactgtattaaaggtagtataacattagaggcagaaagatttggttttgaatgccaggtctgtcactcctagccatataaccttaaaacaacatactttcccacactttggttttctcatttgtgagatgagatgaacaatggacctctgtttaaggtgattgttaaaattagatgtttgtagcacacttagcacactgtgcctggtccacagtaaagtgcttaataaatggtagtcatgatgctgttggagtctgatgaaacaattctctattctctagttggtggagaattttgccaatatgtaggattacactggtgctgtttgccattcagccccgagtgtcttcagcctattgtgatcattgcccttcctcaggtgcacattcttgcagggcagtcatcagctatgtaactgactgctgctccttcaaagctgttttcagcccattggaatgaaagggagccaggtctcttgcctcagagctgggccacataggactgatagagttgaacccatttccacctgatgagctcaattgctagaggtaacactggtgaagctgaggtcataggttcaagccccttttcaacccactggtttgcccccttgcatgactacacacttcctgagcctacacaaacatgtcatgaatagtgccctggatcataggaaggacagtgtgagagcacgccctttcaaacatggttgtatagtgccttctggagaagggtgggtatgcagtatgagcatcactgtcatctttatgcagcagtgccttacacctttggtgagtggtatttgcgtgggaagccattctctagagagtgttgggcattcaccggagtaagcccaagttgtgatcttggttagccagacgttctactcatttatttaccatgtacaagaccttagaatgatgtcactttttcttaaggcacatataccacatagaaatggtcattttattgtatagtctgtgattttatttatagcaagcatctcagtaacctttatttcaccattatactcttaaaagccatatcacagttttgaaagggatgtggctagccacatcatcttatagaggatacaaatgtagccctttgctatgttgaaatgcaaagaaatgctaatgtagtcactattattctccaaattatttttttctcttaaatattgtgtgatgtgttagtttcctattgttgtaacaaattgccataaactttgtggcttaaaataacacagatttattttcttacaacttcaggggtcagaagtgtaaagtgagtttcactgggttaaaatcaaactgtcaacaaggctgcatttcttccagtgtcttttctgggggagaatccatttctctacctttttcatcttctagaggccacctgcattccttggctcatggcccttcctctatcttcaaagctagaagcatagcttcttccactctctctgtctgaactgtgtctgtcttccatcatttttttttcccctgaggcagggtctcgctctgtcacccaggctagaatgcagtggcgtgatcacagctcactgtagtctcgacttcctgggttcaagcgatcctcccacctcagccttcctagtagctgggactataagcatgcaccaccacaccccgctaatttattttttgtagatatagggtcttgccatgttgcccaagctggtcttgaacttctggcctcaagccattctcctgccttggccttccaaagtgttgggattgcaggccatgagccaccatgcagtctttctttcatcttctaatgaaacttgaattatcttgggaccacacagataatctaggaacatttccctagctcaaaatccttaactttgctcatttaccaggtactgtaacatattcacaggttctagggagtagaaagtagtcatctttggggaaccattattatgcctcacaggtagggaggtgccagctttgaaatctccatccttcagaatgtttaagtaaagtctatttaaatatctaagcagaacttatttggcccacattaaaattaaagcaatttgctgctagttccagttattcatagtaacataattcatgatgatgactgtggtggcaatttcttccgaagttggagacagatccacagtaagacatcttaaaagactcatgttttagccatggtaatgggaatcattcgtgagatatttactgagtgcctaccatgtgccgaccactatcctgaggaccctgtgaaaatatagctgctgtgtccagagtatttcctttccattttgctggtagtagaatctcttcactcctgagcaacaatgtcatcatgtggttagaacttctttgaagctatatggaaatccttaactggcagacagactgaacaccatttctgggctcccagcctccttattcccattacagatgggacactttttaatttgatctgaatttcataggctttttagagagacctgaatcaatggttcaacttaaagctatgcacagcgagcagcctggagcaccagcccagctaagtgggtcccaaagtcgatgtatagttcctttttgctgctctggcttggagaataaagattaaaagctgataatcccagcttcatcttaaagcactcaattcagtgttttccatatgctgagctgtggtctggtttcatcacctaaggagcttttacaaactactcctctttgagaggttctgagtcagtcgttttgcatgaggccttggatactggcatcttcaaatgctccccagattattctaatatgcagtcaaggtgggagtgtaaaaaataaagtcctggttcccactgccagggatccttattcagtaagtcctactgaattgtgaacgttcctttggtgattctagcgtgcagctatgtttgggggctgccatcctagcaacaatcttttggcacttttagctatcaggattctgttttccttgtcacaaatgtagatttctgagggctgtctccattccaggctttctgacccagactctgggggctgtccctagaaagctgcaggcttaacacacatgcttcaggtaattcttatcagagagttgtaggaaacattgtgtagtggagtgctacaaagaacttaaagctgtgcctttacttacttagagcaaactaacccgcattctcagctccagcatttggctgattttcccttgtggccagtattcctgaggctgggttgggagtgtatgaagggcaaggttatatgctggtggcatggaatgttttggtccctgattgattctcctcagcctttctgtgtgttgatggctgcctggatagtagatatagttgcctgttaggttgtctggtaagttatcaataaaaaaagatgaagaagtcctctaaagcactgtagataagaaaaagtcaaatcaaataaaactcaatctggacaacagtaaaccagaagaatgcaccaatcgaattttctctgagggagacaactattggcactgaaagctttggtctgtcctgattcagcaaacccacaccaagtataactttttaaagtttcttttacataatcaaatttgtagcaattctagcgtaagaagaaaactgtttattcttgtttcagtgttgcctttttaatttaaaaatatatatatacttttaaacatacagaaaataggaaaaaatagcacattgaacacccatatacacaccagttagattcattaacattttgccatatatgcttcatgcgcattttgcaaaaccattttaaaacattttaagggacactataacacctcattcttaaatcagtatgcaaatgaaggcattcttttataaactacaacatccttctcacagctcataaaattagcaataatggtctagtattcaaaatctagtccatattcaaattttctcagcccccttaggtttaatcaaagattccacattgcattaggttatgatgtctcttaagtagcttttaatctggaagagttacccgttccacctttttttatttttatttttggcaacactgatattttgaagcaatgaggccagttatcttctataacattctatattctggatctgtctgatcgtttctttagtggtgtcatttaacttgttgctctatccctagcatctcctgcaaacaggaaattagatctaaaggcctgattaaatttcagttaaagttttttgaccagagcacttcacaggtcatagagtgtaccagtgcagtatgcgtaggtcataccgcatcacaggtcagaaaacatgtctgttttttctgactactagtgatgtaaaatgtcatcagagcctacggaactctttattgtaaaagtatattttttccacacaaccaaccagtaagtttttggtgaggtgatactttgataccatgagaattctagtagggatgtagctcaaccttttatctaatagttttggtatcagaatgtctttaatactgttttacattaacctttcaactttttaacattttaaatttaaaaatattccaagacatttgctttccacaaaccataaaattttacaaaagtaagattcacttttataataatggcatatttactcattaattggaacgtgagcactctccctctttttaattttgcttgagccctgtataatagccagtatgatagccacttaatgtaccaagagattagcatacttcataaaacattaacatcatcaagaaaatctagacctgtgggaggtggtgggggaatttttggtggtccagaaggaaatggaggcagcaagcatgaggggaagcagggtggtgtgggtggtgggctactgaatttgagacctgacctggctttcgtggtctcagaattccatggagtagcttctgacctgatgctaaatggtttgtttccaggacctggagttctcactttcatccattgaatcttgactttcattttcattcttttgagcattctgtcctatattattagctacagaggttgaagaaagtagatcagacagatttgctcctctctatttccatatccagtgtaaatcacaacacagctttctctcttcatatcaactgaagcaatggtagcagagtaaatgcagctgtcttctgaccaaatggcaggacatttgtccccaactttccactacttcaagaaagttacagtattctttttttggcctttatgcttcttagcaggttttctattaggcatgctttttggtttatctgaggtttcacaaatgtcatcattctttagagcctgtttaaatgaagccacagctttatcatccacttctatcagtgctgtagcatcccaaatgtcagaaacgtcactctggcctatgctgcactagaaatgcaccaaatcttcctgctccaggatgccacagccactgctggcactgcccattgccatcgtaagcctactgccagttttacctttcaatgaatgcattatttcctaaatactaagcacagtcaaaaattgtttccctgagatgatatagccttctcctttggtggcatatattaactttgttagtctcaatatgactaacagtttggattttcaagttcaagaatgtttgtgcagagtcatctgagtcctccctacaggtggtttttttcagcacattttacttagtcaaatcatcaaactattgatcatgtccccacacctaaccaatttataaaactcaaagccatctgcgtggcacggactctccgtagtcttgattgcagagttgatttatgacctaaagaaagagagattttagcttagcttttggatatattcccttctgttgatcaaagatgatggtggttttcagtaagttgactgagcaggaatagaactttttaagtcatctcagttttataggattcaaggcatttcttttccaaggctgattattaattttgcattgaaatccctcataacaataagcctgttgcatagaaacaaatttttgatgaatcatcaaatcatcaaatattttctctttcttcaaaatgaagggcatccatgctaagttacttctgatttaaagatattttaaaaggatcatcaaacatctccacttgatggctatactttgtaagaaagacattttctctgataaagtgtaattgctaccttcttctctgagcatttctttatgaaaaggtggttggtttcactccttgagtgatccctaagttgatttaactctgggtcagtttgtcaattttagttggtaacaaatggggaggaaggcagatttcctgaagggcataaaaataagatattcattttaaaatcccctcctctttctctttgaactgatttggtacaccaggaaggtgagtagaactgatatatagcatggaaacctgaataattttcacaaaccatgtggaagcctttcttttgtcttaatggaggaattttgaggatgaacccaattggaaggtgtaggcaaattcataattccttggaattttcttgcttgtctgatggcaaacttaggatgaaatgtaatccttcattgtgacaaacatgcctactgtttggcagatttgctttttcatccttctatgtggcttttaattttgtatgctactaaccttcctgaatgtaggtcctttacactgcctattatttcaatagcatggtataaattacagttaagccaataaataattgtttctccttctggcacgtccatcccacagttattctttcgttagttgttgactgaagtgatttgccagactgcaaactagctctgaggatcccaggttgaagaagaggctcaatacagagcttacagctagagaggtattagacaaagaaaccaaaggttataagacaggtggacatgtggtataagagagttgagaggacagtgtaaggatttgaatggagttctacagagcaccaaagatgcttgtaactgaacctgtacaggaaggcattctaggcagagggaacagtagggaaaaagagaaaagtatacagcatttggggcaactacatgtagtttggtatgacttaaaggcggagtgcaagtggtaggaaagcaggagataaaattggagaaataggcagagaccacatgatgtcagaccttgttgctagactaaggaactcgtgcttgatttagtggataaatgggcagctatagtgggggtggaggttggaatagcatgaacagctttgcattgtgaagtaggaccccatacttctcctccagagagtatctactgtaagtatcctatgatcccaagcttcacacttttaacaagaatctttgcatgtgtatctcactgagttttcattacatttttattatattggattatctattgctgtgtaacaaattgccctcaaaagtcagcagcttaaaacaatacatatttattatgtcacagtttctgtgtaatctagatatggcttggctagatcttgcagctcagggcctttcctatggatgaaaccaagttactggttcaactggggcatggtgtttccaagttcgcttagtgattgttggcagaattcagttttatcatgggctgttggactgagggccccagttccttgctggcagttggctgaaggacacgctcagtttcttgccacctgggcttcccaaactgccagattgctttattaaagccagtaagagagtctgctggccaggcgtggtggctcacgcctgtaatcccagtagtttgggaggccgaggtgggcggatcacgaggtcaagaaatcgagaccaccctggccaacatggtgaaaccccgtttctactaaaaatataaaaattgggtggatgtggtggcacgcgcctatagccccagctactcaggaggctgaggcaggagaatcacttgaacctgggaggcagaggttgcagtgagccgagatcgcgccactgcattccagcctggtgacagagaaagactctgtctcaaaaataaaaaaaaaagtctgctagaaagatggaagtaatagtcttttataacctaatcatggaaataatatcccatcacttttgccatattgtatttattggaagctagtcacgatgtcctgcgctcactcaagtagaggttccctgtgttgccaggtcagtaggaggaatctagaatgtcatctggatggctgtccactttgaaggctggccttcctccctttaggagtttggtggttggataaggaattatattgtttcttgaaccaaaagtgctggatacctgaaggcacttcctgatatcccaggcacttggacaaacccaaggaagcaggggtacttgtggaaattttgttcctcagtggggcttccttctcctcccctgaagggaaatatggcagagctctgaggcctgatggggcaggaagaagagattatatagagaaaaagtctcagctgggatttttttagactgcttgtttatggcttcaccaattcaactttctggttgtaaatcatggccatttgtctttccctcagggatggttttgtttttggttttgggttttttttgtttgtttgtttttgtttttgtttgagacagggtcttgttcttttgaccaggctggagtgcaatggtgtgatctcagctcactacaacctccgcctccctggttcaagcaattctcctgcctcagtctcctgagtagttgggactataggcacccaccaccacgcctagctaagttttgtatttttagtgcagacggggttgtagatacaggatttcaccatgttggccaggcttggtctcgaactcctgacctcaagtgatctgcccaactcggcctcccaaagtgttaggattatgggtatgagccaccgtgcctggcctctgggatgtttttaatggctggagagcaacccacctcctgactggctgtttggaggccacatttcaacaacatatattccctcccagcactgaggtggcagattctgtccaggtttctctcttataacaggatattccatgcaactatatatttcatctgtaaaactttccactgggattatgactttctttcaaatgtaactgaccctgccctggcattgttttcatacaactgtgtgtcattgcctggcctggaaaagatgccactatccaaatctgctcttgcagacaaaactaaaatttcatttccaaagatatttatccattcaataacatttatcgaatgcctacaatagatcattcttggtgctaatcagggagaatatagcacagtagctaccctctaggagtttacagactagtgtatttgaggttgatgtgtctcattttatataatcttttccctcacacaaacattgcatctagtaaatggttccaagatacttacaaatattaatagcagtgtcacattgttcctcaaaatgtcaaaaaatttatatgatcttatctgtcctgcactttaatgctatggtgtatatttaataaaggattgaatttggtcgatgtcaagagtgacgtgaggagaccctacaagataagtgagtctggaggagtgtgagtgtgcatagcagattccagacccagcctcccggtgatttcttgttcatcttgttccatctcagcttcccactttggtcaaatcacccccaattgaatgagcatggcaaaaatatttcccaaaaagacattttgaacttgcgaaaaaagacattttgaacttgggaatagcggttggtgagcccatagtactagttgtacttactggctctaagaccttagttaattaacctccctaaacctgtttctcaactgtaaaatggagataagaagaatactttaatgcatttatttactaaaaaatgttttattgaaaacaccattcttgtaggtcctggggattcaaagtgaacagaagtcctgtccttctccagctactttctagttggtggagacagtaaacaaatatgtagcaggttgacagtgggggtgaaatgaagagaatgtgagcaacgaatgggatgtggggaggagatgaggtacaatgtacactgggcagccatcttctccctgagaagatgacatttgagagtaaaaaagacaagcataggggagagaggggagttagttgacaaatgagggcaaccgcaagaccagctagagtgcagaactgaaaggtgattctctagaaaacaccatcagagagctcacaggggcctcatgacagcccacagtaggactttacttttcctccaagtgagacagccactggagagttctgtgctgagaagcatcatcatctgatttctgttttaaagatcattctggagtttgggggtggatcaaatgagataatgcctgaaaatcagcacaatgcctggaacatggtaaactcacaataaagattaactccagggaagaggggcctacaattacacagcatcaagcctttgggaacacgtttgtacatttctgtgtccttcaatcatatagacttggatcctaagaaattgagttttttttaaaggatgttcactcaaaaccagtgcggtttacccactttcagggatgccaaggggcataaattgtagagaaggcttagctatttagagtttagaggctcaaaatgataccatgtttaaggatacctttggagcagctcagagcatacccacagaaggccgagaggctgccctctgtgcatttttgctaacagctttgcatagactggatttatgaagtgccaccccatctgctaagccccatggagattcagaaaagccgaggctgattttgatggtgtggaggcatgagaaaaccaactggagattgatgcagggatgaaggtgggtgctgagccactgtgccaaatttagtgtcaacactgaaccggaaggtaggaatgagtttatactgagaaatagcaaatgagagcctgctcaagaggtttgctgagaataagtgcttcttaatggattacgttgtgacttgaaattgaaaattaatacacagaaagagtcaagctcagagaagggcaacctggctgctcaactctggcctgagagatggtcatgggggtttgggtagaagatgattcctgtttgcaagtatgagcaaattttgagtggaggaggaagtgtcttggaaacacaatccttcgtaagtgtacatccaaggtgcccattacagcaagttcttgagaacggtgggtccccggatccaccatgtgcccagcagtttctctgcaatccaggaagttaggcaatggggctttttctctctcttatctgcagaatagaaaggatccatggggcatcacagagcaccgagttctttccagccacgttgcctcttctaacagcatttgcttcagtggtggtttgacagacttgggtgttttagcaaatgtgcagggcctaaggtcaaagaaagcaggccggggtgcactctggtccccattgttcccttttcccttcttgtcttcatttctgttctcccaggtttccctcaggtctctcctcactccttccttttctcctgtcactcattgttctctctcatttgctttcttctcccgccattcttttatgccagatttctcttctttaatcaccgctattaagcatttgaagcagtgagcgatgtgtgtgttcggctgcaatcgttccaaacattggtcgttgccatagtgttcctttagcatgacgccagggaagtgtagaaggcttttgtgtctgccctggggaaggaggacagcctcctgaaggggtctgagtgcggagcaagaggtggatagtaatttagaaagcaggaatttgccgtcaaagctttggggaggtttagaagaggctatttataatccatcagggaattaaaaagaaaataggcaggttctgggatattgctatagatcacctagacaagatgaaaagatagagcagctcaggaaatgtgtttacagataagaggcaagttttaaaagcagggccgtgatcatggggactttgattacacctactaaataatgtataaatgaatgttattcaacaactacagacattgactgacaaaacaacggtgggcaaatggaggcaaaagcatgagccttagcaataaatctctgtagtccaggctccgcgcatggttactcccttgtggccacggcctttccctcttgtcctacagctaggctccttgcagctagctttggggggagttgatacatcattcatttgtgtcttcatttattgtcacacatttgagtaccgactttgggttcagattggatgcatttaggagaaaagattcagcctcagccctgaaggacctcatgggaggcagacaggaaacaaacccagctaacaaaaataagacaatgaaacacgtagagatgtaaacaaaatgtactgaaaacctaggaggaacacctcagtatcagaagtaactcagaactaggacctggtgtttttcaactccagtggaaagagtcttgagatattcctaaatggcatggagagacaaaaatccagcaatcttggacttccctctttcctagtcgggattaaatataaatatcaagaatggcatacattcaaagttccctgaggagctagaattgagtccaaaatgaatctagccttcgtcatttatttcccccaaccctcaaaataagctggtttttggattttttgttgttgtgtgtttgtttttttgagacatggtctcactctatcactcaggctagagtacagtggtgcgatttggttcactgcagcctcaacttcccaggctcaggtgatactgtagctatgcatcaccattcctggctttttttttttttttagagacaatgttttgccatgttccccgggatggtctcaaactcctggactcaaatgatcctcctgccttgggctcccaaagtgctgggattacaggcatgagtcaccaagccaagccaacataagcattttttaaaaaattatttgagataaaaagatccaagtgggccagacaatgaagagtttgtttcttttttgttacatggagagaatgagaatgtggcaaatttggggagcacatttttctatagttggagaaaaccttgttgatgaccaagacttttggattaaagttgggtttaaccatgtgggttgcttctatgagtcaatacttttaaggtaattcaatacaaagacagtgggtaatatcttgaaaatggcaaggacaactgtatctcacagtcaaacatacccttttctttgggggtcaataaactctaagccaccaatcttcagtgttgtgggaaattcttagaaacctcagaatcgtttcacgaagaccagatgacgtatgttagtttcactaaaaatctcaggcttctatttggcacagaaggtctccttcatcttcagatttccatccagagaactaaagatgtccagtcatcaaaagtccatgggtcattgctaaatggcatcaaggaggaaatacaggggctgtagtaaaccaggctgggagtttggttataagcactcactctctaaaactgattagcagtaatattatgaagcctagcaaagattaaaagaaaacattgtcccaaccaagaacaattaaattagaatctttggtggtggggtgccaggtaccaacactttttcaagcttctcagatgattctaatatgaaactagcactaagcatcccagccctcggggctactaatctcggacagatgtgactcagtaactgagatccagcataattttcaaggtgatagttgtacatgttgctcagtgcagaaaacatggaattgggttactctaaatttgttagagcagggtccccaaatgttaccttttgctagaagtgtggttgggttacaacaaacagattgctatggcagaaagtctgagtagaatgcgaatgagcacaggatgggttcataccactggggctcactaggcctttcttagcttttgttttgaaagtccaaaattcttcttctcccagacaggcatttgaaagactggaaagatttggataggaagccctagagagatagacatttgctgagttgaagccaaggatcgagtctcatgcatgtgaaaatctaatacaggtaaatctccaacatatggcagcactaattcctgagaaaggtcatgagtgagcagcaaaagcatgaacaaagccttcaagcccaaagctttgattatgcaaaatagctatttgtggcacttaagtacagtggtcaccctggattttccagagtggtttagattttggctccattatcagtgtgctacatcaatgtccagttttttgaaatcccagtacctgatgccgagtgaatatacagtcatgttggttgaattgagctaaagtccattcccccctccaagttgctcctcacacagaaccaaactctagccacacagacacccaatgagctgagggcagggcaccccaggaatgaaggtcatggccctgtggcaacctcactggatatgcaaggtggaaactggctttctgctggtgcataagccattccctgccttcccgtcaaacagcccagctctaaatctacatttcccactaccggaacttcttttttgggtactacgactgtatctcagagcaaagatctaggcatggctctcccattcctactaattttaagcactgacatctgctttgggacccacacacctggctctaagcaatactacatccccactccacagctgtggttccccacatggccccgccatccctgtggaatacaaaaattaccttgacagagcacttgtttgcattatccccctggaaaacagggtgcattattcacccatatattttggtgaagaaaagcagctgttttcagctaactagtcgttctcagccctggctgcacccatgcctatagaccacaccccttcccacaaccttttgtggcaacctcagcttaagcttttgtcactgtcttgaaatcacatgactagtgttttttcttttcttttttttttctatttccggtaggatcattagctcatacaagtcatcagggaaggactcatccagctcccatctctttctgtggagcagcataatgactgtgtgcacgcattgcagggagcctcaggcactcagacctacaggggactggtgtgaagctcctcatttcaaatgctccgctctattgctctatctgaacatgaggaccttctcttggcagcttagatcctctgttacagcaaaggattggctccaaccaatgggagccagttgctggtggaaaatatgattaccaacacagaggcagctgctgttgctctttgtttttctaactttcaaaagtgtggaacggtagttaaagcccccaacaatcttactcctttctatcccatttcatttcaccgagggttcaaggtagctgcactccaagtaacatcttcaatgatcatattcaaagcatgatgtcacacagggataagagtagcaatttttttttgaatcaatatgtaaacctgactccttcattcagggttacagctctccagtgttttggcctctcatcacatggctctgatgtgtggatcttttgtatagaacctcttggctggtgaaagtctgaactgaaaaggcaccagtatctgttaagacaatcctgttagcctgttattacctgccaattacattgttccttgtttagaaatccagttgaaagaggcacgctaagaactccatcagaagtagctggtgtggatttttgtaagtatgggtagagaatctgcctacggcaagtaacaccagtgctggcatgcccagaaaattccagctggaggtgggagtaagtggcacttggcaaagttgccctcttgacctacttgtttaatttggatggaaaaatgtgttttgtttatgtatttttttcaggaagccattatggtgagtctttccaatataatttccactgagacctctcttattcagctcaattttctcttgggctgaggctgacagagacatggttggtgggagaatctgtcaccctgtggagctgaacagtcttcaagataaagctgcctgctggcctttcactcccaaattgcctgaaacctggtcacgtcccagccaatgtcctctgccttttgatgagctccactgtgaggggagaactagaaactgtgaggagtgggtagactttttcctactgcgcagtgagatgggaatttggttacattaaaaaatacatctgtattccttttatcatgcagatgaagtaaaaaggagtatataaaataaatttatagttttgcatttaaaagagacacagacagagagagaaagagacatctttggcctttgttatttgtttgacatctgcagtcctgctggaccactagcttggtgagggcagctggcaggcaagcctgtgtgctgttgtagccaagcccctagcacagctcatagtaggggctcagtaaatgttgaattaataattaatctccatatcaaatttcctctttgtccgcagtcatgaaattcatacgtgtcttaagtttcaaagcactgagtgaatatagcttgccctaaagcaaacaaacaaaaatagcattgcttggaaagatctcgtttagcaccttagttaccacaagtgctcattagggctttctttttctcttgaaggtgtacatttggctgagcgtgtgtaagtgggttatgtgactagccaaatgccttctctcttctgtacttgaagccctgctctcccaagctgaagagtagatgactacagggaaaatgtgactcatagcaagtgttgttattaaatcaccttgaagtgtctcttgtaaaagataactccctgcattgtagaaatgtctttgacaagagaggattagggtgaaactgcaattaccttgacataaaggaatgaattaactttccaacttgcatttttgcaaggcatagattcaagctgcttggaatataaacattgaacacattcacaatagcttggggcacttgaaaattctaaagatgggcaaggagccccaagatgctaggcaacttcagaggtatttctcaccacagagggagtgcctgtctggacagaaaccgccagtgcagttgtgcagtgtctgctcatgtgtcagcagggtttaggggaccgtcaggacgaatgcctcctggagctgatgcctgcagggtctgcccggaggaaacagagaaatgctcttccaagatttgacttccaaaactacccattcactcgactcaggaaatattgaccgagcacttactatgcgttggggcgttgggccgtgagttcaggcagtcttggctgtcagggacttggaaaagtcacacgttaaacaaatcgtgtgggcatgaacctcagtcaacaattcatgtgcaaaaatacacacttttgtttgttttctttaagtcaaagctgactctaagctctcatcct

SEQ ID NO: 7 - DNA, 38494 bp, Mus musculus
tgtggcccggacacagtggctcccccgcccccacttatcttgagcttgtttgtctcagtaacattgtagctttatcctctagacccttttcatgagctggttcaccttgagccagtttcagtggttaatctatataacctatctttatggaaaatgccatttgtactttcctaaaagggtttgtttttttgtttttttgagacagggtttctctgtgtagccctggctgtcctggaactcattttgtagaccaggctggcctcgaactcagaaatctgcctgcctctgcctcccaagtgctgggattaaaggtgtgcgccaccaccgcccggctgctaagagttttaatgtagacagctcttaagctttgttgtgtacatgggactgagttaattatcaccaggaaacttttttccagatggtgctgacttaaatatgcctagatttacccagttgtaaattctcaaagtttgaactgacactggcctttttatctcacacagttgttaactttgctcgccttggtagtcacagaaacctccacaccttaagtatcactttcttttcctttatttatttatttatttatttatttccaggcagggtttctctgtatagcccagactgtcctggaactcactctgtagaccaggctggcctcgaacttagaaatccgcctgcctctgcctcccaagtgctgggattaaaggcgtgtgccaccacgcccggctttcctttcctttatgatagtcattgtgtttatatgtatgtgtgtgcgtgtgcgtgtgtgtgtgtgtgtgtgtgtgtgtgtgcatgcatgcatgaatgcgtgcttcaagtaattataagtgtacacacgtgtgtgtgagggaatgtagaggccagaggttggtagcaagtgtcttttcccccatcactctccaccttgtatttttgacagcatctctcactaaataagaagctcatccctctggctagattggcagactgatctacctgtctaagccccgcccttccagcactgaggttagatgcagaccaccgtgccctgctttttatgtgaattttgtggaggttctaaactgagagcctggtgcttgcacagcaggaactttaataactaagacacctccacagccccagtgactttactaatacagcaaggagcttgccttcagtttctgttagctcagtgatcctgaaatgagtcagacacagttctaaatgcagcacctgccttgaccccacctatctaggtaggaccctgagcagccaagccccactcctccagtcacctacactgcagtggctgaggcctagaattggtacataggctgctggttgcagttcaggcccatgccctgagccagccacacaggggcttggagctggactcatgcaagttttccaatagaaaaaaggtcactcgtaggagacaaaggaaaacacccagcttggaaacacaaaagccgctgttttttggtttgtttgtttgtttgtttgtttttctacagtacgcccctcatatgaataaaagaaccagaaactactgcagtgtcctgaacggaacagcagagggagacaaagacatggaaaactccaaataatagggttggaagttgaaattttggaaagaaatagacacataaagatgataaaaacaataaagactttttggacatgaagtaacactattttgaacagttgaaaatagttactacctagaattggtagtgatcttagcctcccctgtattggaaccactgggtgaaccaccacactcgcctgaggatgctgaatgcgtacctatatagtgtatgtaaaaatatggagtcatacacctgtggatgagtccctggatttgatgtctagtgtcattaaatactatgttttctgttttgagggtttgtttttttttttttttaaagaagaggatgtatgtataagcattcatctgtcccaggttagcctggaacttcctgtgtatagagtcagacctgaaacttctgaccctcctgtttctccctcccgagagcctgggttatgggactgcaccacctcattcagcaaccactaaatattaaaaaaacatttaaaagtatatgtgtaagtatgggtcccactaactcatggatcatctagctctggtggtagttcatacttacatgacacatgaagattcaaccagggagacaaaagggttaaaaaatttcttcaaataccacatattttaagcattgactatttgatttgaggcttttaaaaactggatagttataattccagcactcaggaaatggaggcaagaggatcaagagctccaagtcttctgggctgtgtgtcagcttaaagaccatccctggctacaagccttgtaacattgatattgtagtcctaggtgtgtaggaaacttcctacatgcacagaggcaatggcaggtggattcctctgagttgaatgccagcatggtctgcatggtgagtgcaagggcagccagggctacacagtgagactctcgtttcaccaaatgaaagaactttgagattattttcccagggctgtcataacaatagcatgattcaaaggtctgacttgaatgcttttccagtctttgcttttctgtttgtctacatccataaaaatggaaaagcatgggtgtgtatgtcttctgtgaatgtaccaagagggttatagataggaaacaacaagagcattgagtcagttttcttgtgaaaacttgataccttttctttatttcagggattcagagatcatgcaacaaaagcagaagatagccaatgagaagaaatctatgcagacaacagaaaaatgatgactggctttttggaaaacctgggtgctattgccagtgggtgcatcatacgctctaagattaaaatttcacagtgactaatcattatatgtgttataacttgtccttataaaactattttaaactttactcttcagcctatcttaatgtgatgttttaagaccatcaaaaaataaagtactgaccttgcatgtaacattattggtgaatattatttttattaaaagagaacatgaatgtaatttattaaataggtaatataatacttacatttgcattgctaggaccatggtacctcacaaggatcagctgaggaggaacaaattgtctcatggttttggaggatttcactccttcatagaaaggagaacagaacagagaggctcggttcatggtggtaggagcacaccctactcttcacatcgaatcagaaattcatgcctggacaggaacctggttaacagtcaaagtcctgtccccaatggcctacttcttccagtgagccccatctcctaaaggtcctatagcctcccaaaacaaggccaccagctgaggaacaagcactcgaactatgaactctgcgagatactggagatgtaagcaacaatgagtagtgcgattcaggactagaatctctcatgtgaatctagaattttggtatatagacttcgttaagtagtttaattttgtgtttttgtttttgttttctgaaacaatctctttctgtagcccaggctagccttaaacacctaacaatcctcctgccttgggatgtgagttctaagatcataagtgtagccacagtgctagccttaaagatctttaactttctgtttgttatacattttcttaaacttaggggagtcatcgctcaccttccaccacgtggctcccaggaattgaactcagagcatggtggcaagtgcctctgtcaactaagctacctcactgcccacccttaactgtgcacgtgcgtgcatgtgtggtgatggccccagtggaggtcaaagggtacacgtgaggagtcaagggttccatgtgaggagttagttcttaccctctgcctcgtgccgtgttcctgctgctgctccattgtcctcccggcagttctatgtccacctcccactgcagcacgaaagctcagagcacaggtgcgtggcaccacatcaacttcttaacgtggcttctggaagctgagctcggatcgtcaagctcctgttttcctctttaccagctgagcccttatctccagttttctctgataaggttggggtatatagcaactttacattgcttgccctagttcagtttccaacaccacacacagaagttccatttatatataagtgttggtttgtaaccagctgcttcactccaagaatttacactagaacaaaccaggaagatcaactaaatgggtaggcactaaatgaggaatcagcaagagtagaattgaactgagtaaataaattaaataataatttaaaacaaccgagccaggtatagtgtcttacacatgtaatctcagactcgggaggcctcagcaggatgactgacatgagtttggggccagagagtgagacactgtttcaaacaaactggggcaggacaggtgactcagcagttaaaagcatgtattgcacaggatctgagcacagtttccagctcctggagttctgttcccagcacccatgtcaggcagctcaaactatctgttaactccaactccagggtgatctgacacttccggcctctgtgggcacttgcattcatatggaagtcagtctggcttttctctacctgctctagctcccaaataaggacatggaagccctatatttattgaaaaacttgtagcattatacctgggcagatgctcatttattgtaaccctattctaacctgtctatggctgcctactacccagccgtgccccattacttgctatcttagtctccacctggctgcacctcctccatcagtatcctcatggtgactccccatcaaactcctctggtccccaccagagacacgatcactgggatcagaaatcctgcctcctcctctcctacccaaccattggctgattggctctttattaaataatcggacgtgatggaaaatttttgcataacgttgtaacagaagatgcttgaaaattccagtatctagattgcaaccagatgtctgggcatggtaatgagcatctgaatacacagtgcacaaaaccatcccccaacacacacacacacacacacacacacacacacacacacacacacgactgtggtggtttgaatatgcctgacccatttggaggtgtggccttgttgaagttggtgtgtcactgtgagcttaggctttatgagcctcatcctagctccctggaagccagtcttctcctgtttgtcttcagaataagatgtagaactctcagctcatcctacatcatggctgcctggacaaagacatgcttctgtcttggtaatggactgaacctctgaatttgtaagccagccccaattatatgttatctgtatgagagttgctttcttcatggtgtctgttcatagcagtaaaatcctaaaacagaagttggtaccagggactggggttgtcttagttagggttttactgctgtgaacagacaccatgaccggggcaactctcataaggccaacatttaatttggattggcttacaggatcagaggttcagtccattatcaaggcaggagtccacacccacagtgacatatctatttcaataaggccacacctcctaatagtgccactccccaggccaagcatatacaaaccatcacattccactccctggtccccaaaggccagttcaaatgcatgagtctatgggggccatgcctaaacatagcaaaatttaaaagcacatttagtccaacttccaaagtctccatagtttatagcagtctcaacagtgttaaaagtccaaggttcaaagtctcttctgagattcatccaatcacttaacttaaatacccaaagcaagacaggaaaccattgggccaactccaaactctgaatctccatatctgatgtcaaagccgtcttgagatctccaactcctttttcatctttgttgactgtggtaaagttctttttcctgggctggttccactccctgttagctggtttcctcagcaggtatcccatggctctggcatcttgaatatcttggggtctccacgtcaacttcagcttcacagcttcttgttccattgtctgggatctacacgtgatcttctgggctcctccaaatggctggtgtcacttttccagctttgccctctgtagcactctaggctctggttgactccactccactggacccccttattctataacattatcaccagctttctgttttccaactccttcactgcctaagctcagctgagataagcttatacatggtagcccatgcctaagagccactgaaaccaaacttggtagtaaatgctcccaatcccaggaaaagctgatgcaataggatgataacaaatttgaggctgggatacgtatcaaaaccctgtctcaagacaacaaaaaccactgaagaagcagaatgacaaacatcttatattctatgaaagcctaaattgaaaaattatttaaaacttcatacaggttttaacttacacgttcattttttaatttttattttatttttattttttttccatttttattgggtatttagctcatttacatttgtaatgctataccaaaagtcccccatacccacccacccctactcccctacccacccacgctccctttttggccctggcattcccctgtactggggcatataaagtttgcaaatccaaagggcctctctttccagtgatggccaactaggccatcttttgatacatatgcagctagagtcaagagctccggggtactggttagttcataacattgttccacctatagggttgcagatccctttagctccttggctactttctctagctcctccattgggagccctgtgatccatccattagctgactgtgagcatccacttctgtgtttgctaggccccgggatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaattctaaggaggggcatagtgtccacacttcagtcttcattcttcttgagtttcatgtgtttagcaaattgtatcttatatcttgggtatcctaggtttggggctaatatccccttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataagactgctatgaacatagtggagcatgtgtccttcttaccagttggggcatcttctggatatatgcccaggagaggtattgctggatcctccagtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattttgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaaaatcctttcccaatctgttggtggtctttttgtcttattgatggtgtcttttgccttgcagaaactttggagtttcattaggtcccatttgtcaattctcaatcttacagcacaagccattgctgttctgttcaggaatttttcccctgtgcccatatcttcaaggcttttccccactttctcctttataagtttcagtgtctctggttttatgtgaagttccttgatccacttagatttgaccttagtacaaggagataagtatggatcgattcgcattcttctacatgataaccaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcataattgctctgtagcaaagctgtaggtcaggcatggtgattccaccagaggttcttttatccttgagaagactttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgactcgtttgagtttattttatatccagctacttcaccgaagctgtttatcaggtttaggagttctctggtggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattacttttatcatgttaaggtacgggccttgaattcctgatctttccaaaacttttatcatgaatgggtgttgtcaaatcttgtcaaatgctttttctgcatctaacgagatcatcatgtggtttttgtctttgagtttgtttatataatggattacattgatggattttcgtatattaaatcatccctgcatccctggaataaaacctacttggtcaggatggatgattgctttaatatgttcttggattcggttagcgagaattttattgaggatttttgcatcaatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccgtctggtcctgggctttttttggctgggagactattaataactgcttctatttctttaggtgatatgggactgtgtagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcatttggttaattctttgaatagttcttcttgtttccacttggttgatttcacccctgagtttgattatttcctgccatctactcctcttgggtgaatttgcttcctttttttttctagagcttttagatgtgttgtcaagctgctattatgtgctctctcccgtttcttcttggaggcactcagagctatgagtttccctcttagaaatgctttcattgtgtcccataggttttgggtacgttgtggcttcattttcattaaactctaaaaagtctttaatttctttctttattccttccttgaccaaggtatcattgagaagagtgttgttcagtttccacgtgaatgttggctttccattatttatgttgttattgaagatcagtcttaggccatggtggtctgataggatacatgggacaatttcaatatttttgtatctgttgaggcctgttttgtgaccaattatatggtcaaatttggagaaggtcccgtgaagtgctgagaagaaggtatatccttttgttttaggataaaatgttctgtagatatctgtcaggtccattcgtttcataacttctgttagtttcactgtgtccctgtttagtttctgtttccacgatctgtccattgatgaaagtggtgtgttgaagtctcccacctttattgtgtcagatgcaacgtgtgctttgagctttactaaagtgtctttaatgaatgtggctgcccttgcatttggagcgtagatattcagaattgagagttcctcttggaggattttatctttgatgagtatgaagtgtccctccttgtcctttttgataactttgggttggaagtcgattttatcagatattaaaatggctactccagcttgtttcttcagaccatttgcttggaaaattgttttccagcctttcactctgaggtagtgtctgtctttttccctgagatgggtttcctgtaagcagcagaatgttgggtcttgtttgtgtagccagtctgttagtctatgtctttttattggggagttgagaccattgatattaagagatattaaggaaaagtaattgttgcttcctgttatttttgttgttaaagttggtgttctgttcttgtggctgtcttcttttagttttgttgagggattatcttcttgttttttctagggcgtggttcccgtccttgtattggtttttttctgttattatcctttgaagggctggattcgtggagagataatgggtgaatttagttttgtcgtggaatactttggtttctccatctatggtaattgagagtttggctgggtatagtagtctgggctggaatttgtgttctcttagtgtctgtataacatctgtccaggctcttctggctttcattgtctctggtgaaaaatctagtgtaattctgatagggttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatggtcatctctttctttagatttgggaagttttcttcaataattttgttgaagatgtttgctggtcctttgagttgaaaatcttcattctcatccactcctattatccgtaggtttggtcttctcattgtgtcctggatttcctggatgttttgagttaagatctttttgcattttccattttctttgattgttgtgccgatgttctctatggaatcttctgcacctgagattctctcttccatctcttgtattctgttgctgatgctggcatctatggttccagatttctttcctagggtttctatcttcagcgttgcctcactttgggttttctttattgtgtctacttccctttttaggtctagtatggttttgttcatttctatcacctgtttggatgtgttttccggtttttctataaggacttctacctgtttggttgtgttttcctgtttttctttaaggacttgtaactctttagcagtgttctcctgtatttctttaagtgagttattaaattccttctttatgtcctctaccatcatcatgtgaaatgcttttaaatccaggtctaccttttcaggtgtgttaggatgccctggactgggcgaagtgggagtgctgggttctgatgatggtgagtggtcttggttcctgttagtaggattcttacgtttacctttcgccatctggctatctctggagttagttgttatagttgtctttgtttagagattgttcctctgttgattttgttaccctctactagcagacgtgggagactagctctctcctctgagtttcagtggtcagagcagtctctgcaggcaagctctcctcttttagggaaggtgcacagttatctggtgtttggacctcctcctggctgaagatgaaggcccaaaacaggatctttcccagaagctgtgttgctttggccaggaaggtggccggttttctggagccgaagatgtcaccgcctcctcatttttttaaattgcaggtttttgtggttttgagacattgtttcagtgttctgttgggtaaatatcccctaatttagctaaggcactctgccttttaccagctcagtaggatgtgtttcccagatactctgtccatgtccgcagctgggaacattctcttaacaaacgatctacacccacatcactatcagtgtgcccctggtccaattttattttgttaaatcctggaacacaagaacccacaaatctcactgggcgcttttgggatgccctattgtctatgccctattccaagatcccctaaattgtagaaaacagtgggttttgccaggctgtgccctgccctgggagagtccatcatagtttgagacaggggctcgctgcaaacctctgactggcctggaacttcgtatgtagaccaggctggccccaactcatacctgcttgcctctggaaactccaccctacaagcagcttctgactccatcttgagggaggtgactgaaacctctgggtacaccagaaatagcaccatctgccaggacttatctagttttttgtttgttttctacaggctgataggtggcttattcctgagtcaatctgtaaatttattgggataaatcaaaactatggtggcacatgggatatcgaaattctatcaggaaaatcagactcaggaatttaccagatatgccagatgaaggaaatggtcgactccccttacctcaaccttgggcccattacaaaacagacacctaacactgcaaaaggcccgataccaacccatcgtctaataattggtgtgtgcatcaagaaccagcaaacacaggatgcccttattgtgaaggttcatcccaaactcgggaagctgaggtagcaaaggccagcctaggctatatagcgaggctgacttgaaaaatgaaaagaaaagggctggagggaggaaaataaattggaagaaaacagagggaaaggttaaaaaaaaaaaaaagaactagaagacaggtggaggggagaaagagaaaagacagatgtgggaggagtgagttggaagcgtgtaggaggtctctggctgcctccgggccaccgtactcttccggtcccagaagccccatgacggaagtcgtcattgagtgagcccggcagcgtccgtggtagcaggccatggcgatgggcagtggcggagcgggctccgagcaggaagatacggtgctgttccggcgtggcaccggccaggtgaggtcgcggctcggcgctagcactcggagcgctgcccgagaccgaggcggtgcgagctcgggccacatccgcaggcggctcctggtgcagctcgggcgccggcgaggctgtgagccacgctttggtcctgtgtgactgtgaggggatgtgcaggaacggggacaggctggctgaagcaaggcaaccagataggagccattggaaagctccagatttaggtcaggatgaagatgttcacagggactttagactaaaatgctggttttctggatccagttttgtaaccggaaagaccaagtgttgcaaacaacagttgataaagtttgagagagagggataactaaagttgcccggagtagttgaaagttgctattgactgcattgcattcaaatgtatacgacagcagatccgaggcagggttggtggtgcacgcataattacatgcacaaacacttgggagatgggggccggagggtcgggagttcaagatcctcggttacagcgtgaattccggaccagcctaaattacagggagactgtagaagtaagataaacactggtaagtacgagggcaaatcagagccaagttggtggactgtgcatgtgatcagtcccagctcctgaggcaggaatgtgaagttgagtctagcctgggaaacaacatactccatctaacgaagtttaaaacattaggacctcggtcgtcttatggtatggcaactgatttctgcttggggcttggggtgggagaagagaattctgggcagctttgggcagtgctgcatttccttctttgggggacagcccagcaattcctattctgaataaagctttgccctttgtcctcaggggagccctggcggtctggttctctccttaaaaccacaaggttcctgtgctaatttgtcatcgtggtaacttcttcatgcccagggtgatgggtcatgtttacaatctcaggggtaatcttattgattgcagcttctttcttgttgctgttttgttgttttgagacaggtctcacagggtagccttaggagacttggaactctccatgtaagccaggctggcatcaaactcaaggagattgccccgtctcagccccccctcccgcccccatttgaatcagggacacattccataacctaaattggcctggaattcaatatgctagactggcctggagctcttggcaaccctactgtctccagctccgggatattgggattgtagattatagatatgagccattttaatttgtagttcatggttttgtttttgtttgttggtgtgcttgtttgtttgttgggatagagttttatgttgtagtctatgctgtctgggaacccactatagcccagaccagttttgccttggcagtcctctgcttctactgagtacattgaggctttcttaggtgctaggatctctgtgttcgtgcgtggtgactttctagaaatgtatctgcctgtaacacacactctgagtgtctgggctgtaggcattgctgggggttgatctagggactttgagctacttccccagtacttcctattatctgttttttattaagcacatctatctataacttattttttattttttctccctcttcagagtgatgattctgacatttgggatgatacagcattgataaaagcttatgataaagctgtggcttcctttaaggtatgaaatggttaatcatttttttccttatttcctcaggtcatacattttgtaaagaaagagagagaagaaaaataaacttgagcacattgaggctttcttaggtggtgggacctgttatgttagaaagtagtgactttttaaaaatatatccctccatgacacatagatcttatttatttatttatttatttatttactgttttcatagcatgctctaaagaacggtgacatttgtgaaactccagataagccaaaaggcacagccagaagaaaacctgccaagaagaataaaagccaaaagaagaatgccacaactcccttgaaacaggtgatagattgatttaaccagggtcctgcccggcctgaggggcggcatgctgcttctgtttggagtgtcccagagctgtggatgaattagcaaacgcacacatacacacacaggcgtgtgcgcacacacatgtgcaggctgggcattaaaaccagagctctctgcattctgagtatgtgctgtgtagctgatatgcaactcaaccccccccccccccccacacacacacacaagttcaacaattataaaaattactagggtaactcaaaacttgtggtaactgggtctgctattgaaagcagaagacctgggggtatagtgtaccagcaaagtacctggctggttacaggcccagcctgtgtgcctgtgtgtccctgaccagacccacattgagtcagcacaaaaccctatagactagaggtctcattctctcctctcttcttttctctctctctctctctctctctctctctctctctgagtttttttgtaaagtgaatagtttgatgcctccttccattcattatttccaaagggaaagggtgtctacatttggtgaacacttgcttttctttgactaagaacactggatttgtcatacacgtttggtctcttttgttcttaatgacacgtttcggtggtggaatacattatagccattcatcaggccgggaaaaggagatgcaggtgactaagaacagtgtttataatgaagtgaatgggaggactggaattacacttggagaactgggttatggtttgttcttttcagaagaaggaatgttgcgtgtccataactttcttttcttttgtagtggaaagttggtgacaagtgttctgctgtttggtcagaagacggctgcatttacccagctactattacgtccattgactttaagagagaaacctgtgtcgtggtttatactggatatggaaacagagaggagcaaaacttatctgacctactttccccgacctgtgaagtagctaatagtacagaacagaacactcaggaggtgaggccccgaaagatgtccattcctgaaagtggacactaagtaaggaaaaagcattagaatcagttgtcacgttgacgcacgaaggcgttgaatgacattctcattctctctggttctccttttgctggaacgcaaggtcggggccataggaatgcttgtcggtgccctgcctttgcataatacaatgtttccttttctttttaaagaatgaaagtcaagtttccacagacgacagtgaacactcctccagatcgctcagaagtaaagcacacagcaagtccaaagctgctccgtggacctcatttcttcctccaccacccccaatgccagggtcaggattaggaccaggaaaggtaaatgttctgttgagaaaaatatatatgtaggcaggaatgagtgtggggagcctaactcttcattgagtaatggatagctttcctgtgaaccaggagcttccgggcctgcgtctggaaagaggaaacgcacagtgaagtaagaggctccctgcactgccatggctggctggcatgtaactggtacactttcctttttacagacttttatgacactatagtgtgtgcatgaggaccacacagaggaaggaaagagctgctcttataagctggcttctgacttccacacatcctcgttcctccatctataaatgatgggggattacaggaatgtgccagccaccacaccttgtttatcccagagcatagtacagggttaaagtgtgaacactttgtatggctcttttggttgtaagtagtagaagtcaacttaagaagaattgtattataagctaggttatggctagaagaaccttaactagcttgttgtgttttgttgtttgttttgtactaagtagcagtattttcccttagagggcatggtatttagataattcgtgcatgtttgtgtgtgtgcgcgtgcatatgtgtgctgtatgtgggaaggaactagtgccagtggcagccagaggtctacactgagcatcttcctcaatcactctctaccttattttctggggcagatcgtgtcagtgaacgtggagcttgctggttcagccagcctggcctgccagagccccagggatcctgtctccatctccccagtgctagggctaagaatatgttctgccttgccttgttgctatgtgggtgctggggacccaagctcaggcctctcttttcacccctagatagtaatttgtaaaaattaagtatagcacctcttcaggctttctctgagaagtgagtagagtagaagtgagcactggagatacggcgaggagaggattactgagtttgggaccagcctggcctccatagagacagttttgaaaaaaaaaaaaaaaaagacaaaactaaaacgtaaactgaaaacaactgatgcaaggtggtgccgtgggtaaaggcatctgctgccagcccgccggcctgagcgagttccctgcagtctcttggtagagagagaaaaatgattcccaaaggttgtctctgggttccacatgagcactgtggtacacacttgtactggctagttttgtgtcaacttgacacagctggagttatcacagagaaaggagcttcagttgaggaaatgcctccatgagatccagctgtaaggcattttctcaattagtgatcaagggggagagaccccttgtgggtgggaccattcctgggctggtagtcttggattctataagagagcaggctgagcaagccagggaaagcaagccagtaagacatccttccatggcttctacatcagctcctgcttcctgacctgcttgagttccagtcctgacttcctttggtgatcaacagcaatgtggaagaataagccgaataaaccctttcctccccaactgctcttggtcatgatgtttgtgcaggaacagaaaccctgactaagacaatgctccatacatgcatgtgcacacaactaaattaattaatgttttagaaaatttaaacaaccaaagattttctgtgataattttctaattaaaggttacattgtgctgggtggtgagatggctcagtggttaagagcactgactgctctactgaaggtcccgagttcaaatcccagcaaccacatggtggctcacaaccatccgtaaaaagatatgactccctcttctggtgtgtctgaagacacctacagtgtacttacatataataagtaaataaatctttttaaaaaaaaaaaaaggttacattttgccaggttgtggtggcgcacgcctttaatcccagcacttgggaggcagaggcaggtggatttctgagttcaaggccagcctggtctacagagttccaggatagccagagctatacagagaaaccctgtctcaaaacaaaacaaaaaaaaaaaaaaacaaacaaaaaaaggttacattgtattagagtttcttgaatctggagtgatcaaattctataaaatatatcttgtctttttggtagtttttacaatgtactctagcatatataagtaacagaatctctaaaactttttctttcctcagtttacacttatttatttggggtgggtactgtatacttaatggaagtaaaaggacaacgtatggaagtgggttctcttcctttgcgtgggtcctgggagttgaactcaggccgccagtcctgcccacaagtaccttttatctgctgagccgtcttgtggacccagtaacaggatatctacaaaaatatgtgatagtgggggaagaatgtattcctgtgattagactatcttggtaaatacattgtctctggtcgactgagtcattacagatctttactgtgattttactttctaaatgtttatatagaaaagcaacggaaaacaatgtacgatttgcgttaagatttgcttcatttgtagttacgtatatgtgtacatgtctgtgtgtgggctagtacatatgatgcagatgccgttaactgctgagccatctctccagttcttacttctcttacattggttttgaatactctttctttcagtgacggaagggatttttccttaagatactaacttggaaatattctttatagccaggtctaaaattcaacggcccgccgccgccgcctccactaccccctccccccttcctgccgtgctggatgcccccgttcccttcaggaccaccagtaagtacacaagagctgaggttacacttttatatacagttagtaattgttttagaatataggtaattggagtgcgttaccttaggccacccctaaggttggattctaatgagtaaaaatgtaaacctctggttttgtctggaaggccctctgttacccagatggtctctcccagtctcactgccaagctctgcttggtgtggttcccccctcactggttggtatccagtttcctgctgctggtttctgttagaaaggactgtcctcagtatacagaggcgacagatactatgtcccttggagtacttgaatgagagtctccgagcctgtactttctcaggggcttgcctcttgtcattgtttgttttcatcctaatggaggtttttggtttgtttggttttcaagaccaggtttctctgtggaccagccctggctgtcctagaacaggttgggccttaactcacagagatctgcctgcttctgcctccctagtgctgggattaaaggcctgcgccaccactgcttggccctaatagaagttttatagtagttttatttttagatattaacagtagttaaaaggatatttgggggcagactgtatttgagtgggagacaggcagatgttctactctaaatctttccttatggtgtccttaaaaatactgtgtgtgtgtgtgtgtttgtgtttgtgtttgtggaaagacttgagtctctgttttgtgtcttatgcatagcttcataatggaacaaaatagtccattcatactattaaatgtcaactggttttaatttttgttagatttgttggtcttttcttattttttcttctttaaagatttattattctacataggtagactgtaactgactttagactcaccagatgaggatgtcagatctcattacacatggttgtgagccaccatgtggttgctgggatttgaactcaggaccttcggaagagcagtcagtgctcttaccggctgagccatcttgccagccctggccttttcttattatggttggctttcttccagtgctagattcaaaaattaaatagaagtatctcattgagtttaggaaaaggttcagttaataattcattattctctgtgtaaagtgaatccctgggtttcagtatttccctaatcctaagtggattttttccatttgcagataatcccgccaccccctcccatctctcccgactgtctggatgacactgatgccctgggcagtatgctaatctcttggtacatgagtggctaccacactggctactatatggtaaggactccctgggaactgccagacatgctctttgcagttgtacaacttttggtgatgagtcttgcacctagagccagctcctacataactaaaatgtggtttgttctatagtgcttaaaaacgttaagtcagttttaagaccactttaacatttaaaaatggacaatacttctttcatcattcctcctgagtgtgattgcaactcatttcaaatgtctgcttttgttatcttgtctggtctttttcaagacactgtttctctgtgtagccctggttgtcctggaactcactctgtagaccaggctggtcttgaactcacagagatccacctgcctctgcctccctcccaagtgctaggattaaaggcgtgcaccaactcccagctcatttcaaactccttgattggcagtaattctagcactcagaaagctaaaacaggtagattacaagttccaggctagcatggatacacagggagccgctatcccagcagcaaaccatgtaacagtgggaagggaggcttaatgctgctaggttattttaattgtactttaaaatgtaagtgaaacctaaattagttcctagactgtttttctgctttggggatgatgatttttgttttcccattgtgagattggatcttgctgtattcttcaagctggccttgaactctggaatccccttaccctagccccccgaggaacagggactgcatgtgtgcaccatcattcctggacatacttgctctgccgtggatagagtcttacactgactcgtttggccaggtttcccaggtgttggagatcgcaccctggggcttgggcatcctgggcaagccccaccactgagctgtatctcagcctggccagtttttgaagtttaatgtttcgttggtaagcttgatctacattctttttttattttttatttttatttttttttatgattcttgactctttttttttcaaaacttattgtttattgtgggaaaatacacagtatcttcaggggatggaatttatgttgttggaatgaaagttgtttatactgaatagattttcttcccatagtttcatatggaattgagttgcatggcagttatggcctgtagagacctttaaaatcacaaatcaaagtgccattttaatcgtggtacttttatggcagcttctgcaactcctctggatatgtctagtccaagaggacactttggttcatttcggatgtcttctacatcatgtaaaacgcccaagccagcacgtactctttcagttccattccatgtagccgtgatgccattgtcagtgcacagtcctggagggggggcacaacaacgtgcactgtgctgcatttgcgatgatttccagtgcttttcgggtgtacaagtcacttgcaacacctccagatacaaccagattacgtattatgtttgttaaggtccaggcggcagggacactacagaaggggatgctgagtaatacaataggaagcggccaactcccaaagcatatgtcagccacgtatcacggctgttcattacacgagtattggggtttacctcactgtgggcaactccaacattcatgtttgctcggccaccagctcctggcaggtcacaggacaattcctgcagcagccacagtaggtcctcatgctcgagcttaatctacattcttgtgtatagttatcgctctgttacctcccattgtatagatatgaaagcattctgtttatccattctactattaatgactgcttatgttgtgatttgggccagtaaaaatgtttctggggttggagagatggtatagcagttaagagcaatggctgttcttctggaggacccaacttccattcccagttcccatagggctgctcccaacagcgctcaccctggccggtacttttaactccagtcctaagaagctcttgttaggtagccatgctccttaaagtagtcacgccaactcagagctaaccagagaagtgcttccctttaggagcatcatctgtgtgtgtgcgttgatggcatttcactagattagtttgcttaacttaaaatatcaacatatgcccttaagacgtgtgggaagtgtgtgtccttgagtgtgaagatctgagggttttacctttggaaggagtagacaagcttgtcagtcaggctttccagttgcccgagacttgtgacgatctcactgacttccacgagcagttcatagcccttacagagtgtgaccaagccacagtgtttgcctgcccagtcaggatggtggcggcagcgccatggtggtcgctgctcacctctgcggttctgtcttgtagaaattcaagcagaacaagaatgagtaagagtggtggtgttattgcaagaacgtaaatgtgctctagctttggtcttcattggtaccaagacaccttcagtacatctctggctgttgagatgtaaatgtagatgcactgtgtagcctagggtggccttccaatcacagcagtcctcttgtattagctttctagttgctgatggtacaagtgtgtgccaccatgcttgctttggatcaatcactgttaaagtatattggaatgctataaactactttttaaaatacataaacttattttcagatgaaactaaataaagttagcatgcctcatgaaatacactgttcggttgttctagtagtgctggagatcaaacccagggccttgcgcatgttaggcaagatctctagcagcagactgttcccattctcatggttttctgtgtcaggtcttcctgtcatagctcagcctttctccagccaggctggccttaaaatcaaagtcctcttgctttggtctcctaagcactgggattattaggtacatatcactaagttgggcgaaagggctatttgtttcgttgtattctcttttgcttttttaaaaaagagacaaggctagccttgaactcacagagatcctcttgccctgatttccaattcctggaattacagacatctgccacatctcccaacacgaggcagagtctgctgtgtcccaggcagttttagactcatcatgtatctgaagatgactttgaactccgggtcctccttcctcctcatctcagggctggactgcccatgcatcaccaagcttggcatccagccgggcttgaattgttcactcacacatttatttagtataccctgcttagctttttatatgctctctttacagggtttcagacaaaataaaaaagaaggaaagtgctcacatacaaattaagaagtaagtctgtcattttaaaagctaattttaccttttgtataatttttagtttgtgtaaaaagagtgttttgaacatttgaaaattgatgtttatgtaaaactatactaaagacattgtatttatgtgtagtgtgtgtgtgttgagggtgggggtgcgtggctgacagaagaggacattggatcccgtgagcttgagctgcgtgtggttgtcagcttgtcatggtgctgggacctgaactcagagtctagaagaacagtgagtgctttttaaccactgagccctctctccagccctgctaaagtctgccaaaaatagattaactattgaattatcctcacatgatcaaatactcatggtgtcagaaggccttgaactccgtgttagcctgcctcggtctccatagcatgaggattatagacatgcagctctgtacctggtttaaaatctggtttagggtgtgaagttaattgcagtgtcattggcctggcaggcttgagtttttgtgtgggatgtggtagtagggattgaacccagggccccacacataaggaagcattctgccactgagccgtatcaccagatccatgggtagtttttatgttaaacttctgtgtgtgtgtgtgtgtggaggttttgcctacatgtatgtttatgtgccatgtacatgcctgatgctcttgaggctagaagaggatacgggatttcgtaaaactggagttatatgtaggtggttataagttgcccaaatctactaacaagactagtaagtgctattaaccactgagccatctctccagacccatcccctcttttaatacatgatgcagtatgcagtatactgcattattgtcttagtctattgctgtgaagagacaccatgaccaaggcaactctcataaaagaaagcttgctacagtttccgagggctagtccatgagcatcatggcaggaagcagacaggcaggctctggagtggtggctgtatatatggagtttttattgtaactttctggaggcctaatattttgagttcatttttaactttaaaggcatgtaacattctaatccaggtgtctaatttctagttctactaccccccccccccaaacaaagctggttatattgttgcagtcactttagtgaactaaacattagtgaaaagtttaacacatgatttgataatttgtaatatgtttaaattctaataggagaggtcaaatatagtacttcttaattttttaaattaatgttcacatttatttattttggtttttttctagacagggtttctctgtatagccctggctgtcctggaacccactttgtagaccaggctggcctccaactcagaaatcctcctgcctctgacttccaagtgctgggattaaaggtgtgcaccaccactgcccagctaatatatttttattttttgcattctatataaaaaatatttgggaactggtaaggtgcttcagaggccaaaggcctgatgacctgagtacactccccagggtggaagaagagaaccagttcttactagttgtctctgacctccacactcacacacatacatgcacacacaatttttatttatttattgtcattttataactgcccagagttttttctttcaaattcaggttcagctctgtctcaggagatggggtgtcggtgtccctggtcgacaagaacagacgtctcctcgtcatcagtggactcttggctaagtggtgtcgtcatcagcatctccccgctgtgggagtccatccatcctaagtcagcagcagagcgtgcctggggcgtgagcagttggagggaccgaccagtggagtgtgcgtgtcggaaggcagtctacccagtcgtgactgagcacaaatgtgcaattgtcattttcttagcatgtcaagatttttattaatgcctttagaattaaataaaagtccttttttgaaatcttgactttatagatattttcctttgggatatatacagtgaagttgagtttgtttaaagatacaaaaagaaaactagtcagacttattacttgggtaaaagggcaatttctgaaggtagaataaattgatactccaagtttggggaacaaaagctagctcatgtcaccggggctatactggccagtcaggaaccaaggcgtgttgtggttttgttttgtatgtttgtgtgccttgctgcatgcatgtgtgagtgtgtgtgtgtgtgtgttttgtccatggctcatatgtggaggtcagagaacaacttgggaagtcatttctctctttctatgtaggttttagggattgaattcaggtcatctggtggcaggcgcctttacctgttgagccatcttaccagcccagttcttcatttattgaaacagtcttgttgtcagcctggcttacttgtaatacacagtcctcttggctcagcctcccaaatgctggcctcaccacagcagcaaatgcaactactaccacaccctcactgtgttctgtccgttagaagccatgttgttctctttgcaccttcccctgtttgtctttctagtctcctcctctccccctgatgtcccttacctcatcatgaatactgcctacaccaattacccatgccattctccgcccccgcccccgcccccctcccccacggccttggccatgtaccatgtagattcttatggtaaggattgatgtcttcagcacccaggcttctccctggtttatttgcctttgaaggaagaagtaaatgtgatcagctggagatggaacccatcgatacaccatttgacgacgtgtgcaaggcactggggtttgatctccactattataaaaacagagcatggtcaatgctatctttgcctaagttttagctaggtaaactaaattaattcagttccccatgtgcctatcatttagccatcaagtaagtactatcaaattaatgaatacctacctagtaagtaactttgcaaatatgttctcatttgagcttttagaagaaatattggctattatagattcaacataacttagttaattttcaggttaaatttaattattaagacactcagttaaccttctaaccagacattagttattaacactaattttaactctctttagcgcccaaaacatttatctggactgaggcctttcattccagcaaatactcaacattatttcaatgctgggaattgctctcagcaaagctagaagggtgcatcgtatgtcggcatgtaatgtagtcccagctactttgaaagctgaggtagtaggattcatccttcgagaccagcctggccaacataaggaaaccacagctaatacagtaataacagagagaggcagtggagatggctccgtggatgaaagcatggggaaaggacagaggtggggatcactgcaggatcactgtgagttgctggccatcagcctagcccaaagccataggttccaggttctcaagggaataatgcaggcagtgacaaagacaccgatgaagatctttgtgcgtgtggaaacaggcatatgcatactcatgtgtactctatcatcttacacacaacatggaaaatagcctatggggagttgttagaaagatttagtttggctcacagttctgggggttcagggctgatttatttggtgcgctgagcttgaatcaggcataatattccaagaggcaacaaaagcatgatttctgcatatcttgtgtgtgtgttcatacttggcctctcaggaagccaccaggattcagtgggaacttcatcttgatgactgtactggctagttttgtgtcaacttgacacagctgcagttatcacagagaaaggagcttcagttgaggaaatacctccatgagatccatctacaaggcattttctcaattagtgatcaagggggaaaggccccttgtgggtgggaccatctctgggctggttgtcttggttctataaaagagcaggctgagcaagccagaggaagcaagccagtaaagaacatccctccatggcttctacatcagctcctgctttctgacctgcttgagttccagtcctgacttcccttgctgatgaacagcagtatggaggtgtaagccgaataaaccctttcctccccgacttgcttcttggtcatgatgtttgtgcaggaacagaaaccctgactaagacaatgactttatcctaaataccttctaaaggccccagctgcaaacacagtagattaagtcccactcctagaggctcatagtggggattgcattttaacatacattatttgggaaatactcaaaccatggaatgagagaacatagttaaaggaaaaggctcttgtataagaatgtgtgtggagcagggcaggggtgtcgtacacctttagtcctagtgctggggaggcagagcctggtggacctctgagttggaggccagcctggtctgcagagtgagttccaggacagtgggggttacacagataaacctagacttgaaaaactaagaatatgaatgaaatattcaagaaccagcaaggccagagtgagaggaagtagagataggagataggaagaagcaggagcaagggtcaggtcatatgtagatgatggtgaggttgacagcgttggccttgagctgggagttcagagaagagggaggcacaggtagagatgatctgacctccaggaggatcctctgggtgtgactgcatggtggaaatacactgatttcacagaagtgggctggccacgtgggactgtgtattttgcaagtggaattgccaggatttgtcagtagattatatgtggtgtaagagaagctaaggataactaactccaggggtttcactaagcacctgcaggggtgaagcgggagtttcggggggtgaaagtctacacaaagagtacctcagtgaagagttagcgttggagatgtggattgccagtgtccattggagttctattaacagagtgcagggctagagctgtagacggaggagatagtgtggacatggagcttaaagccatttggcaggatgaggtggtccaggctgtgtataacacagagacaaagccaggagaactcagatcctccaggggttagaggagaaacagcagagggtcgagctggagctctctgcggaaagcaggggtcattgatgctccaagggctcctggcaggagcaggtgcgtcctggaggccagggaggagccccatctgtagctcagctgctgctgacaggacagatatgataaagtctgcagcgcagtcattgactaaaccaatgtggaggtcagaggtcactggtgatgctacgagccagtgtggaggtcgcagtgatgctaaagcagctattttggtgagatggagatggcaaaagcttgggcgaagagaatgtaagcaggaaagacacttatcagtgatcgtaaggaactcttccaacaaaaagttggtttttttttccagacttgttatatttggagcttaataaaatcacatttgatatctatttgtgtgagtttacaattatttttgtcacctgtttcagttatgctctatgtgcactacgatgaaaaattgatttcttgggttgttttgttttttttaacttaaaaataaagcggatgtcctaagaaggtgcaaactgttctgcccatttgacagattcagggagctggaatacggaggatgtggtcaggggccgatgcagctttggcgttttccttttaagtgttgaggaacaaacaagaccactgaattctttttagaactgtttctttattgaaaaaaaaaaagactttaaaagttttcttttatgggtatgggcattttgtctgcatatgcgtgtgtaccatgtatttgtctggtattcagtgagtccagaaaaggacattgggtcttagaaccggagttagagctgtttgtaagctaccatgctggtaatggaaactgtgcctgggtcttctgcaagaatcactacggcttttaaccactgagccatctttccagcccctctttccttttcatgggcagtgctagtcatcaaacccaggccctcacacatgctggaccgccgagcagcctgcctccccaactcttcctctactttattttgagaccgtgtctctctagattgatcaggctggcctcaacttgtgtttctcctgcctcagccttcagagtagctaggtttaaacacatgtactactgcatacagcctacctaggtttttttccacccgcgctactcaatgagttaagtcagttgccaagttattgtctcctgtttctaaattgagtatttatgatgtaacaggcttcctgttctgaactcctctccccagtcatccctgcatgcacagaggatgctgccgagacactgagggaggtccttgcagcaccagctctagccacaggcaccttgtgtcacacgcagtggctggcagcactagcattctgaggtctcttgcagccaaatactgcccagcagctcctagcagcttcatggccctagtgagctttgttgtcatggctttgtcctgcaaggcacagctcagattgctcagtattgtttgtgttgttattcaatttaatgtttatcctttatatgcccctgcctgtgaccctggaatactgtcttagttagggttttactgctgcaaacagacactatgatcaagacaactcttaatatgaacaacatttaattggggctggcttacaggttcaggcgttcagtccagtatcattatggtggaaagcatggcagcatccagacaggcatggtgggggtggggagggagcttaagagttctacatcctgttctgaaggcagttaggagtagactgacttccaggaatctaggaagaatgcctcaaagcctacccccaccacaacatactccttccaacaaggccatacttcctaatagtgtcactccctgggccaagcatattcaaactctagttagtgccagggaaatgttagtgatctgcatctccccccccccaaggtgtaacctgggggtgcaggtctgttgggggaataacctggagatgttggtcctgttaagagtgtaacctggagatgctggtcttgttgaggattagcctagagactagagctaggtttgggttttgttggggagtaatttggaaactagtgctgggtaccaggcctgttagtttacctgagttcaaacttaggccaggttctctaaaatggagtctgaacttaaaagatgtggcctctcaaaaccaccacaaatacaatttcttatgttgtagtaacctcccaaccatgaaattatttttgttgctacttcataagtaattttgatattgttatgattcataaatatttatgtttttttgaaggtcttaagtgacccctgtgaaaagatcatctgaccctcaaaggggtcaagacctacaggctgagaaccactgctctatagaaaaacatgtttcgccacatgcaacttgtcttcatgattgtgtatagcctgaactcagaagaacttttctcaggtagtttttcttaactctcagagtataaactgtctgatgctctgaataaagctgactattgcatgagactttagtctgcctcatttattggctctattctcccaagtcctactgcctctagagaggtgatagttatgaaatgacaaataattatcacaatcaagttaatatacccagaaattcttgcaagattaaatgacatacccagaacagagtaaatttccaacaaaattataaagctatcttaatatatgaaaaagcctctggaacaaaaacagttttctctaagccaattccccccccccccccaattagatgagagatggcataagcaagcaaggccacacaagactggtgtacatgcaaaagccctgcaaaaactaaagagcatctcctggggggagggtgagctgtagccatggtaaagtcaactcctgatcatcctgtatagagctgactcaatccttaaactggccatttcttacgtatatgaattattccttccacagtgtagtttttacatagagcaatgttcctttccccaggccctttctgttgaccttgataatggagggttctctgtatgaacttgactaaagctctaatctttatacaaggactgccaaggcacagctcctcatagttcaatgtagatatgcaggctctcaaacagttaccagtctgatgcagttcaagaatatttttgtgcatgcaatagtaaacaatttggttttgatttgggtctagagtcaagtcttgttacataacccaggctggactcaaaactctttttttttttttaaaagatttatttaatgtatatgagtacactgtagccatcttcagacataccagaagagggcatcagatcccattacagatggttgtgaaccaccatgtggttgctgagaattgaactcaggacctctagaagatcacggtgctcttaagcactgggccatctctccagccccggctcaaactcttgatccccctgctcaggctcctaagtactaggattgcaccatgcctgtctagagtgaaatgtactagaaaatcaggtttttggacctgccagtaatcttccacttcatccttcacttctgaatgacaggagagaatggcactacccacctccagtgaacagtcaagcgtttggactgagggtgtctttccttcacatcattaatcacttttatgtcctcttcatccaggagccaactgagcatcccgagcctggtgaggctgggcagtcgggacacacactgacccagagccttgacagtgatggcctgaatttgaatgcattctgggatatgcctggaaatgtccaggtttttcaggtttggcaggttgtccaggacttgaaagaaatttctgtatccttcctctgtaatcttgtgattcagtgtaaggtctaagttctcaagtttttggaagcctcccctggttgctcccttggctggaaagaaagcaaccaaaatattatgaagaaaaagccttgagcaaagcttacaaggttatttgtaagtaatctcacacccaccaccagtgaaagcatgaaccacaagagcaggtcccactacatagctctggatagcctacaactcacttagatagcggaggctggtctagaactcacatctgcctacctgtgccttttgacagttgggattaaaggcagtgtgtcacaatgtttaactttaaacatgttttaaggagtgttctttgaaagccctaaacagcagcctcgttgatagggaacaaggccatactgcaagggcaaagcagaaaccaggatgttgagcacagagaatttttggaaacctaccgtctgggcaacgtgaaattctgtacttacaggacatatgccaaggcaggaacaggttacagtacaagaaactgagaaattgtgggaacagtgtctttccttttgcagagaaagcttgtcctctcactgtgactgttttccggtttgcctaaatagcttcctggtgacttagagctctggaggaattgtgggtaagttctgaactaaagtccatgacgggaagtggggacctagaagttttagttgcaaaactctgttccctaatttgtgcaaatattacatttgatttcaccaagaatctctgtgagcttggctttaaagacaaaagtcctaagtaagatgtttcaactgtgtcctaagtagggctggtcagtgatagtcacttttctgacaaaggaagaaagaaagaaagggagggagggagggagggagggagggagggagggagggaggaaggaaggaaggaaggaaggaaggaaggaaggaaggaaggaaggaaggagggaaggaaggaaaatcttaaaagctactaaatagcaggaaaacacacctcaccattaaggacatcatagcacaagaacagcggatactgacaactaaagaaaaaaagtgatgcaggccagaaacctaagtgaaagtaactccaaaatagaatgcacagaagtatcattaaaattcagaaaagtcatgactagctaacccagagtagaagaaatgctaccagagtccttcaggcaggagcaaaggggacactggtgagaggaaatgtgggggttcagaagtagcctcagcagccgccttgtggtgtggatcgatgcattgcagccggcagaaacagtgactgcagcactcagggaaggagctgaaaggttactgcaaggtggtcaccagttgggctccacaggagaccttgtctcaaaaacagcaacagtaacacataagagaatcaataaatctagcttgtaaatgctaaaccacagaactgtttgaaatactaatcgaagggttgaaatggatgtaaaaactaaaataatctttatttttacattttgtgtgtgtgtgtgtgtgtgtgtgtgtgtgtgtgtgtgtgtgtgtgtatgtgtgtgtgtgtatgtatgcctctatgccacagcatgtttatggaggtcagaggacaattttagacagttaattttcttctttgaccttgtggggtcaaacacaagtcttgaggctagacgaaaagcccccttacctgctgagccatcttgacaacccagataaatagaaattaaatattccagaggtacctacctgactcataaagtggtaaaagtatgcattcatatattagtttatgttttttttcttcaaatttcaaaccttattattcaagataacactgaaagaggaaaacgtggagctggaactctgtatggctacgtaagccttgatttctgaagcaggaggatggctatggattcaaagccaacttgacttcacattgtgaatttgaagccaggctgggctacagagtagaccctacctaaccaccccctgaagaataaggtaataaatgtggaaatcaaaaagcagagggaaaacctcatattgtacagaagaaataaagaaaccaatatcaagtaaaaattcagagggctgacacacccctgtcatcttagttctggggaagttgaagcaggaggatcctaagatgaggaccatcaaggactacatagtaagttaaagaagtccagactagactattaacccacagacactgtctaaaagaaacaggtaaaaaaaattaactatattaacaatataatacagtaaaataatatagtatattaaatataaataaaaaattaatggattgggtttttattttaaaatttctgtgcgtgtgtgagtgtgtctaagtgtgggtgtgaatgtgtgtaagtgtgtgtgtgtggaataccatgcacatgtagatgtgggtgtttgtggagaccagaggttaatggtggatgtcttctcagttggtctccactgcagagagaacatcttatgtctgcatggatgtggcgcctgtcaataataaatctgacagcctatggtgaaagcaggaaccaggaggtgaaacatcctggcggcagaaaggattctgggatagtgtgaggagattcacccagggaacacgtgacaagccagacgcatagtacttgaaaaacaggtaaccagccacttggcagaatataggtcagaataaatgggttatattaagttatgatctagtgaaagaagagcctggtagtacggccaaggtatttgtaaatatattttgaatatatgggagcatgggattggtaggaagaaccaggcataacttctatactccacctaactttttaagaccagttttcactaaacctggagctcaaagattccactattttgtctggttagtaagtgccaaggattcccctgccctcagctctacagtgtctcctcttttggatgcttttttcatatcacacctagggcttcattgcacagtctgggagcactgggcagatgaagccagttttgcaaccccagatttgtatcaggtcttacttagatgattgtgaatttttgttgttgttgttgttattctgagacaagacctcttgtagcacatactggccccttgcttactacgtggccaagaatgatgacttggatgatgaatatcctcttgtttctacctcttgagttctgggcttacagatgtgtactcttataacgactatgcctgcttgtatgtcatgctagggcttcgtgcatgctaggcaagcattttaccaactgaactccttcctagagtcaacctttaagcctaactatgtaattgtggaagagactcgtcttgaattttggtacatagattaaaaggcaggcaaaagacatgcaaatgatactgggcacctatcttagcatacaagaagtgatcgcaaggcaagaggtgtcaccacaggtaaagagcactggcctaccagaaagaccttacaactctgcatgggctgtgtgtctcacttgaagatgtaaaagcaagtagagctatgaggaaggtgggcaaggtgacagagatctaccagttgatgatttagttggggatagagcatgggattctggcattggtggtgacctgtgttctaattctggtaaaatcagataaaatccctaagaccctgaactggagaatcctgttcagctccagcctacagacttgtacagcttcttacatatattgtaaatactcaggtaataaaatgagtaccctgccaggtttgtgaaacaccaactatcacacagccttgactgagcttggtgcaggggtagaacactggcctagagagtgaggcattgggttcagttcccagcactgggaaaacaagaccacaggctggatgcttctacagctccctgaagaggctgttgcctttcccagtctgaccaggatgaaccagagtctgcggaagggcacgagaggaagcagcaggaaggaggacatgaggaagtagggtgaacagttgtctttatagacacttgcagcaggcagctccaacgattctgctggcttctgcacatgggaaccccttcgacactcaccaatttccagtacactgtcgtcatccagagtctctgcaaagacaagaactcggagacatgggagctgcagacactgccggacaatcagtttggccacttggtgaatcccgtccccagtgggaacgaacagtttctccaggttcctgagagaacccagagcctgggctgtgggagacacaagagagccatcctcaggagctgttccattgtgagcagcttatgacttacaaggtctgtcgtctaaggaggtcccacctagcacaggccctcctcatcctgtcctctccaagggcaggagaaggggtcagcacagagctgctccctgctgctctctgccgctgcttcctccatcctcccccaacctgtccgttcacccaagtcctcactgtctctccattcccacttcctctcccacagccaggcttcctctggctgcaggtcactttactgactccacaatgccttcatcccacccttctttaccaccccaccctctgccagcacctcaatgatttcaggctgaggagacccacactagacactaaagcatgttccaccactgtgacagccctccttcccaagtacactctgctcagcaggatagtctgtagatcacatgatcactaagtctacctctgaagccccatagaaactattctgaaaactttctagcatggaccaatggtccagatttatctttggctttccctgtttcagctcttgaatgaagcatgtctccacagaccctaattcttttaggaaagagcatttagaaatcaagtccagggattcgggcagttgatacattgcttgcttagcatgcttgagaccctcggcgaagggataacctcttgtgcactgtgtggaagcagcacctgtcaaagaaaagctgatggcctcttagcaaaaggtgggaagtacaaggttctgggtaagagattgcaactctgggagatagtcagacatgagagattcatctcgaactctgagg

SEQ ID NO: 8 - DNA, 38494 bp, Mus musculus
cctcagagttcgagatgaatctctcatgtctgactatctcccagagttgcaatctcttacccagaaccttgtacttcccaccttttgctaagaggccatcagcttttctttgacaggtgctgcttccacacagtgcacaagaggttatcccttcgccgagggtctcaagcatgctaagcaagcaatgtatcaactgcccgaatccctggacttgatttctaaatgctctttcctaaaagaattagggtctgtggagacatgcttcattcaagagctgaaacagggaaagccaaagataaatctggaccattggtccatgctagaaagttttcagaatagtttctatggggcttcagaggtagacttagtgatcatgtgatctacagactatcctgctgagcagagtgtacttgggaaggagggctgtcacagtggtggaacatgctttagtgtctagtgtgggtctcctcagcctgaaatcattgaggtgctggcagagggtggggtggtaaagaagggtgggatgaaggcattgtggagtcagtaaagtgacctgcagccagaggaagcctggctgtgggagaggaagtgggaatggagagacagtgaggacttgggtgaacggacaggttgggggaggatggaggaagcagcggcagagagcagcagggagcagctctgtgctgaccccttctcctgcccttggagaggacaggatgaggagggcctgtgctaggtgggacctccttagacgacagaccttgtaagtcataagctgctcacaatggaacagctcctgaggatggctctcttgtgtctcccacagcccaggctctgggttctctcaggaacctggagaaactgttcgttcccactggggacgggattcaccaagtggccaaactgattgtccggcagtgtctgcagctcccatgtctccgagttcttgtctttgcagagactctggatgacgacagtgtactggaaattggtgagtgtcgaaggggttcccatgtgcagaagccagcagaatcgttggagctgcctgctgcaagtgtctataaagacaactgttcaccctacttcctcatgtcctccttcctgctgcttcctctcgtgcccttccgcagactctggttcatcctggtcagactgggaaaggcaacagcctcttcagggagctgtagaagcatccagcctgtggtcttgttttcccagtgctgggaactgaacccaatgcctcactctctaggccagtgttctacccctgcaccaagctcagtcaaggctgtgtgatagttggtgtttcacaaacctggcagggtactcattttattacctgagtatttacaatatatgtaagaagctgtacaagtctgtaggctggagctgaacaggattctccagttcagggtcttagggattttatctgattttaccagaattagaacacaggtcaccaccaatgccagaatcccatgctctatccccaactaaatcatcaactggtagatctctgtcaccttgcccaccttcctcatagctctacttgcttttacatcttcaagtgagacacacagcccatgcagagttgtaaggtctttctggtaggccagtgctctttacctgtggtgacacctcttgccttgcgatcacttcttgtatgctaagataggtgcccagtatcatttgcatgtcttttgcctgccttttaatctatgtaccaaaattcaagacgagtctcttccacaattacatagttaggcttaaaggttgactctaggaaggagttcagttggtaaaatgcttgcctagcatgcacgaagccctagcatgacatacaagcaggcatagtcgttataagagtacacatctgtaagcccagaactcaagaggtagaaacaagaggatattcatcatccaagtcatcattcttggccacgtagtaagcaaggggccagtatgtgctacaagaggtcttgtctcagaataacaacaacaacaacaaaaattcacaatcatctaagtaagacctgatacaaatctggggttgcaaaactggcttcatctgcccagtgctcccagactgtgcaatgaagccctaggtgtgatatgaaaaaagcatccaaaagaggagacactgtagagctgagggcaggggaatccttggcacttactaaccagacaaaatagtggaatctttgagctccaggtttagtgaaaactggtcttaaaaagttaggtggagtatagaagttatgcctggttcttcctaccaatcccatgctcccatatattcaaaatatatttacaaataccttggccgtactaccaggctcttctttcactagatcataacttaatataacccatttattctgacctatattctgccaagtggctggttacctgtttttcaagtactatgcgtctggcttgtcacgtgttccctgggtgaatctcctcacactatcccagaatcctttctgccgccaggatgtttcacctcctggttcctgctttcaccataggctgtcagatttattattgacaggcgccacatccatgcagacataagatgttctctctgcagtggagaccaactgagaagacatccaccattaacctctggtctccacaaacacccacatctacatgtgcatggtattccacacacacacacttacacacattcacacccacacttagacacactcacacacgcacagaaattttaaaataaaaacccaatccattaattttttatttatatttaatatactatattattttactgtattatattgttaatatagttaattttttttacctgtttcttttagacagtgtctgtgggttaatagtctagtctggacttctttaacttactatgtagtccttgatggtcctcatcttaggatcctcctgcttcaacttccccagaactaagatgacaggggtgtgtcagccctctgaatttttacttgatattggtttctttatttcttctgtacaatatgaggttttccctctgctttttgatttccacatttattaccttattcttcagggggtggttaggtagggtctactctgtagcccagcctggcttcaaattcacaatgtgaagtcaagttggctttgaatccatagccatcctcctgcttcagaaatcaaggcttacgtagccatacagagttccagctccacgttttcctctttcagtgttatcttgaataataaggtttgaaatttgaagaaaaaaaacataaactaatatatgaatgcatacttttaccactttatgagtcaggtaggtacctctggaatatttaatttctatttatctgggttgtcaagatggctcagcaggtaagggggcttttcgtctagcctcaagacttgtgtttgaccccacaaggtcaaagaagaaaattaactgtctaaaattgtcctctgacctccataaacatgctgtggcatagaggcatacatacacacacacacatacacacacacacacacacacacacacacacacacacacacacacacaaaatgtaaaaataaagattattttagtttttacatccatttcaacccttcgattagtatttcaaacagttctgtggtttagcatttacaagctagatttattgattctcttatgtgttactgttgctgtttttgagacaaggtctcctgtggagcccaactggtgaccaccttgcagtaacctttcagctccttccctgagtgctgcagtcactgtttctgccggctgcaatgcatcgatccacaccacaaggcggctgctgaggctacttctgaacccccacatttcctctcaccagtgtcccctttgctcctgcctgaaggactctggtagcatttcttctactctgggttagctagtcatgacttttctgaattttaatgatacttctgtgcattctattttggagttactttcacttaggtttctggcctgcatcactttttttctttagttgtcagtatccgctgttcttgtgctatgatgtccttaatggtgaggtgtgttttcctgctatttagtagcttttaagattttccttccttccctccttccttccttccttccttccttccttccttccttccttccttccttcctccctccctccctccctccctccctccctccctccctccctttctttctttcttcctttgtcagaaaagtgactatcactgaccagccctacttaggacacagttgaaacatcttacttaggacttttgtctttaaagccaagctcacagagattcttggtgaaatcaaatgtaatatttgcacaaattagggaacagagttttgcaactaaaacttctaggtccccacttcccgtcatggactttagttcagaacttacccacaattcctccagagctctaagtcaccaggaagctatttaggcaaaccggaaaacagtcacagtgagaggacaagctttctctgcaaaaggaaagacactgttcccacaatttctcagtttcttgtactgtaacctgttcctgccttggcatatgtcctgtaagtacagaatttcacgttgcccagacggtaggtttccaaaaattctctgtgctcaacatcctggtttctgctttgcccttgcagtatggccttgttccctatcaacgaggctgctgtttagggctttcaaagaacactccttaaaacatgtttaaagttaaacattgtgacacactgcctttaatcccaactgtcaaaaggcacaggtaggcagatgtgagttctagaccagcctccgctatctaagtgagttgtaggctatccagagctatgtagtgggacctgctcttgtggttcatgctttcactggtggtgggtgtgagattacttacaaataaccttgtaagctttgctcaaggctttttcttcataatattttggttgctttctttccagccaagggagcaaccaggggaggcttccaaaaacttgagaacttagaccttacactgaatcacaagattacagaggaaggatacagaaatttctttcaagtcctggacaacctgccaaacctgaaaaacctggacatttccaggcatatcccagaatgcattcaaattcaggccatcactgtcaaggctctgggtcagtgtgtgtcccgactgcccagcctcaccaggctcgggatgctcagttggctcctggatgaagaggacataaaagtgattaatgatgtgaaggaaagacaccctcagtccaaacgcttgactgttcactggaggtgggtagtgccattctctcctgtcattcagaagtgaaggatgaagtggaagattactggcaggtccaaaaacctgattttctagtacatttcactctagacaggcatggtgcaatcctagtacttaggagcctgagcagggggatcaagagtttgagccggggctggagagatggcccagtgcttaagagcaccgtgatcttctagaggtcctgagttcaattctcagcaaccacatggtggttcacaaccatctgtaatgggatctgatgccctcttctggtatgtctgaagatggctacagtgtactcatatacattaaataaatcttttaaaaaaaaaaaaagagttttgagtccagcctgggttatgtaacaagacttgactctagacccaaatcaaaaccaaattgtttactattgcatgcacaaaaatattcttgaactgcatcagactggtaactgtttgagagcctgcatatctacattgaactatgaggagctgtgccttggcagtccttgtataaagattagagctttagtcaagttcatacagagaaccctccattatcaaggtcaacagaaagggcctggggaaaggaacattgctctatgtaaaaactacactgtggaaggaataattcatatacgtaagaaatggccagtttaaggattgagtcagctctatacaggatgatcaggagttgactttaccatggctacagctcaccctccccccaggagatgctctttagtttttgcagggcttttgcatgtacaccagtcttgtgtggccttgcttgcttatgccatctctcatctaattggggggggggggggaattggcttagagaaaactgtttttgttccagaggctttttcatatattaagatagctttataattttgttggaaatttactctgttctgggtatgtcatttaatcttgcaagaatttctgggtatattaacttgattgtgataattatttgtcatttcataactatcacctctctagaggcagtaggacttgggagaatagagccaataaatgaggcagactaaagtctcatgcaatagtcagctttattcagagcatcagacagtttatactctgagagttaagaaaaactacctgagaaaagttcttctgagttcaggctatacacaatcatgaagacaagttgcatgtggcgaaacatgtttttctatagagcagtggttctcagcctgtaggtcttgacccctttgagggtcagatgatcttttcacaggggtcacttaagaccttcaaaaaaacataaatatttatgaatcataacaatatcaaaattacttatgaagtagcaacaaaaataatttcatggttgggaggttactacaacataagaaattgtatttgtggtggttttgagaggccacatcttttaagttcagactccattttagagaacctggcctaagtttgaactcaggtaaactaacaggcctggtacccagcactagtttccaaattactccccaacaaaacccaaacctagctctagtctctaggctaatcctcaacaagaccagcatctccaggttacactcttaacaggaccaacatctccaggttattcccccaacagacctgcacccccaggttacaccttggggggggggagatgcagatcactaacatttccctggcactaactagagtttgaatatgcttggcccagggagtgacactattaggaagtatggccttgttggaaggagtatgttgtggtgggggtaggctttgaggcattcttcctagattcctggaagtcagtctactcctaactgccttcagaacaggatgtagaactcttaagctccctccccacccccaccatgcctgtctggatgctgccatgctttccaccataatgatactggactgaacgcctgaacctgtaagccagccccaattaaatgttgttcatattaagagttgtcttgatcatagtgtctgtttgcagcagtaaaaccctaactaagacagtattccagggtcacaggcaggggcatataaaggataaacattaaattgaataacaacacaaacaatactgagcaatctgagctgtgccttgcaggacaaagccatgacaacaaagctcactagggccatgaagctgctaggagctgctgggcagtatttggctgcaagagacctcagaatgctagtgctgccagccactgcgtgtgacacaaggtgcctgtggctagagctggtgctgcaaggacctccctcagtgtctcggcagcatcctctgtgcatgcagggatgactggggagaggagttcagaacaggaagcctgttacatcataaatactcaatttagaaacaggagacaataacttggcaactgacttaactcattgagtagcgcgggtggaaaaaaacctaggtaggctgtatgcagtagtacatgtgtttaaacctagctactctgaaggctgaggcaggagaaacacaagttgaggccagcctgatcaatctagagagacacggtctcaaaataaagtagaggaagagttggggaggcaggctgctcggcggtccagcatgtgtgagggcctgggtttgatgactagcactgcccatgaaaaggaaagaggggctggaaagatggctcagtggttaaaagccgtagtgattcttgcagaagacccaggcacagtttccattaccagcatggtagcttacaaacagctctaactccggttctaagacccaatgtccttttctggactcactgaataccagacaaatacatggtacacacgcatatgcagacaaaatgcccatacccataaaagaaaacttttaaagtctttttttttttcaataaagaaacagttctaaaaagaattcagtggtcttgtttgttcctcaacacttaaaaggaaaacgccaaagctgcatcggcccctgaccacatcctccgtattccagctccctgaatctgtcaaatgggcagaacagtttgcaccttcttaggacatccgctttatttttaagttaaaaaaaacaaaacaacccaagaaatcaatttttcatcgtagtgcacatagagcataactgaaacaggtgacaaaaataattgtaaactcacacaaatagatatcaaatgtgattttattaagctccaaatataacaagtctggaaaaaaaaaccaactttttgttggaagagttccttacgatcactgataagtgtctttcctgcttacattctcttcgcccaagcttttgccatctccatctcaccaaaatagctgctttagcatcactgcgacctccacactggctcgtagcatcaccagtgacctctgacctccacattggtttagtcaatgactgcgctgcagactttatcatatctgtcctgtcagcagcagctgagctacagatggggctcctccctggcctccaggacgcacctgctcctgccaggagcccttggagcatcaatgacccctgctttccgcagagagctccagctcgaccctctgctgtttctcctctaacccctggaggatctgagttctcctggctttgtctctgtgttatacacagcctggaccacctcatcctgccaaatggctttaagctccatgtccacactatctcctccgtctacagctctagccctgcactctgttaatagaactccaatggacactggcaatccacatctccaacgctaactcttcactgaggtactctttgtgtagactttcaccccccgaaactcccgcttcacccctgcaggtgcttagtgaaacccctggagttagttatccttagcttctcttacaccacatataatctactgacaaatcctggcaattccacttgcaaaatacacagtcccacgtggccagcccacttctgtgaaatcagtgtatttccaccatgcagtcacacccagaggatcctcctggaggtcagatcatctctacctgtgcctccctcttctctgaactcccagctcaaggccaacgctgtcaacctcaccatcatctacatatgacctgacccttgctcctgcttcttcctatctcctatctctacttcctctcactctggccttgctggttcttgaatatttcattcatattcttagtttttcaagtctaggtttatctgtgtaacccccactgtcctggaactcactctgcagaccaggctggcctccaactcagaggtccaccaggctctgcctccccagcactaggactaaaggtgtacgacacccctgccctgctccacacacattcttatacaagagccttttcctttaactatgttctctcattccatggtttgagtatttcccaaataatgtatgttaaaatgcaatccccactatgagcctctaggagtgggacttaatctactgtgtttgcagctggggcctttagaaggtatttaggataaagtcattgtcttagtcagggtttctgttcctgcacaaacatcatgaccaagaagcaagtcggggaggaaagggtttattcggcttacacctccatactgctgttcatcagcaagggaagtcaggactggaactcaagcaggtcagaaagcaggagctgatgtagaagccatggagggatgttctttactggcttgcttcctctggcttgctcagcctgctcttttatagaaccaagacaaccagcccagagatggtcccacccacaaggggcctttcccccttgatcactaattgagaaaatgccttgtagatggatctcatggaggtatttcctcaactgaagctcctttctctgtgataactgcagctgtgtcaagttgacacaaaactagccagtacagtcatcaagatgaagttcccactgaatcctggtggcttcctgagaggccaagtatgaacacacacacaagatatgcagaaatcatgcttttgttgcctcttggaatattatgcctgattcaagctcagcgcaccaaataaatcagccctgaacccccagaactgtgagccaaactaaatctttctaacaactccccataggctattttccatgttgtgtgtaagatgatagagtacacatgagtatgcatatgcctgtttccacacgcacaaagatcttcatcggtgtctttgtcactgcctgcattattcccttgagaacctggaacctatggctttgggctaggctgatggccagcaactcacagtgatcctgcagtgatccccacctctgtcctttccccatgctttcatccacggagccatctccactgcctctctctgttattactgtattagctgtggtttccttatgttggccaggctggtctcgaaggatgaatcctactacctcagctttcaaagtagctgggactacattacatgccgacatacgatgcacccttctagctttgctgagagcaattcccagcattgaaataatgttgagtatttgctggaatgaaaggcctcagtccagataaatgttttgggcgctaaagagagttaaaattagtgttaataactaatgtctggttagaaggttaactgagtgtcttaataattaaatttaacctgaaaattaactaagttatgttgaatctataatagccaatatttcttctaaaagctcaaatgagaacatatttgcaaagttacttactaggtaggtattcattaatttgatagtacttacttgatggctaaatgataggcacatggggaactgaattaatttagtttacctagctaaaacttaggcaaagatagcattgaccatgctctgtttttataatagtggagatcaaaccccagtgccttgcacacgtcgtcaaatggtgtatcgatgggttccatctccagctgatcacatttacttcttccttcaaaggcaaataaaccagggagaagcctgggtgctgaagacatcaatccttaccataagaatctacatggtacatggccaaggccgtgggggaggggggcgggggcgggggcggagaatggcatgggtaattggtgtaggcagtattcatgatgaggtaagggacatcagggggagaggaggagactagaaagacaaacaggggaaggtgcaaagagaacaacatggcttctaacggacagaacacagtgagggtgtggtagtagttgcatttgctgctgtggtgaggccagcatttgggaggctgagccaagaggactgtgtattacaagtaagccaggctgacaacaagactgtttcaataaatgaagaactgggctggtaagatggctcaacaggtaaaggcgcctgccaccagatgacctgaattcaatccctaaaacctacatagaaagagagaaatgacttcccaagttgttctctgacctccacatatgagccatggacaaaacacacacacacacacactcacacatgcatgcagcaaggcacacaaacatacaaaacaaaaccacaacacgccttggttcctgactggccagtatagccccggtgacatgagctagcttttgttccccaaacttggagtatcaatttattctaccttcagaaattgcccttttacccaagtaataagtctgactagttttctttttgtatctttaaacaaactcaacttcactgtatatatcccaaaggaaaatatctataaagtcaagatttcaaaaaaggacttttatttaattctaaaggcattaataaaaatcttgacatgctaagaaaatgacaattgcacatttgtgctcagtcacgactgggtagactgccttccgacacgcacactccactggtcggtccctccaactgctcacgccccaggcacgctctgctgctgacttaggatggatggactcccacagcggggagatgctgatgacgacaccacttagccaagagtccactgatgacgaggagacgtctgttcttgtcgaccagggacaccgacaccccatctcctgagacagagctgaacctgaatttgaaagaaaaaactctgggcagttataaaatgacaataaataaataaaaattgtgtgtgcatgtatgtgtgtgagtgtggaggtcagagacaactagtaagaactggttctcttcttccaccctggggagtgtactcaggtcatcaggcctttggcctctgaagcaccttaccagttcccaaatattttttatatagaatgcaaaaaataaaaatatattagctgggcagtggtggtgcacacctttaatcccagcacttggaagtcagaggcaggaggatttctgagttggaggccagcctggtctacaaagtgggttccaggacagccagggctatacagagaaaccctgtctagaaaaaaaccaaaataaataaatgtgaacattaatttaaaaaattaagaagtactatatttgacctctcctattagaatttaaacatattacaaattatcaaatcatgtgttaaacttttcactaatgtttagttcactaaagtgactgcaacaatataaccagctttgtttggggggggggggtagtagaactagaaattagacacctggattagaatgttacatgcctttaaagttaaaaatgaactcaaaatattaggcctccagaaagttacaataaaaactccatatatacagccaccactccagagcctgcctgtctgcttcctgccatgatgctcatggactagccctcggaaactgtagcaagctttcttttatgagagttgccttggtcatggtgtctcttcacagcaatagactaagacaataatgcagtatactgcatactgcatcatgtattaaaagaggggatgggtctggagagatggctcagtggttaatagcacttactagtcttgttagtagatttgggcaacttataaccacctacatataactccagttttacgaaatcccgtatcctcttctagcctcaagagcatcaggcatgtacatggcacataaacatacatgtaggcaaaacctccacacacacacacacacagaagtttaacataaaaactacccatggatctggtgatacggctcagtggcagaatgcttccttatgtgtggggccctgggttcaatccctactaccacatcccacacaaaaactcaagcctgccaggccaatgacactgcaattaacttcacaccctaaaccagattttaaaccaggtacagagctgcatgtctataatcctcatgctatggagaccgaggcaggctaacacggagttcaaggccttctgacaccatgagtatttgatcatgtgaggataattcaatagttaatctatttttggcagactttagcagggctggagagagggctcagtggttaaaaagcactcactgttcttctagactctgagttcaggtcccagcaccatgacaagctgacaaccacacgcagctcaagctcacgggatccaatgtcctcttctgtcagccacgcacccccaccctcaacacacacacactacacataaatacaatgtctttagtatagttttacataaacatcaattttcaaatgttcaaaacactctttttacacaaactaaaaattatacaaaaggtaaaattagcttttaaaatgacagacttacttcttaatttgtatgtgagcactttccttcttttttattttgtctgaaaccctgtaaagagagcatataaaaagctaagcagggtatactaaataaatgtgtgagtgaacaattcaagcccggctggatgccaagcttggtgatgcatgggcagtccagccctgagatgaggaggaaggaggacccggagttcaaagtcatcttcagatacatgatgagtctaaaactgcctgggacacagcagactctgcctcgtgttgggagatgtggcagatgtctgtaattccaggaattggaaatcagggcaagaggatctctgtgagttcaaggctagccttgtctcttttttaaaaaagcaaaagagaatacaacgaaacaaatagccctttcgcccaacttagtgatatgtacctaataatcccagtgcttaggagaccaaagcaagaggactttgattttaaggccagcctggctggagaaaggctgagctatgacaggaagacctgacacagaaaaccatgagaatgggaacagtctgctgctagagatcttgcctaacatgcgcaaggccctgggtttgatctccagcactactagaacaaccgaacagtgtatttcatgaggcatgctaactttatttagtttcatctgaaaataagtttatgtattttaaaaagtagtttatagcattccaatatactttaacagtgattgatccaaagcaagcatggtggcacacacttgtaccatcagcaactagaaagctaatacaagaggactgctgtgattggaaggccaccctaggctacacagtgcatctacatttacatctcaacagccagagatgtactgaaggtgtcttggtaccaatgaagaccaaagctagagcacatttacgttcttgcaataacaccaccactcttactcattcttgttctgcttgaatttctacaagacagaaccgcagaggtgagcagcgaccaccatggcgctgccgccaccatcctgactgggcaggcaaacactgtggcttggtcacactctgtaagggctatgaactgctcgtggaagtcagtgagatcgtcacaagtctcgggcaactggaaagcctgactgacaagcttgtctactccttccaaaggtaaaaccctcagatcttcacactcaaggacacacacttcccacacgtcttaagggcatatgttgatattttaagttaagcaaactaatctagtgaaatgccatcaacgcacacacacagatgatgctcctaaagggaagcacttctctggttagctctgagttggcgtgactactttaaggagcatggctacctaacaagagcttcttaggactggagttaaaagtaccggccagggtgagcgctgttgggagcagccctatgggaactgggaatggaagttgggtcctccagaagaacagccattgctcttaactgctataccatctctccaaccccagaaacatttttactggcccaaatcacaacataagcagtcattaatagtagaatggataaacagaatgctttcatatctatacaatgggaggtaacagagcgataactatacacaagaatgtagattaagctcgagcatgaggacctactgtggctgctgcaggaattgtcctgtgacctgccaggagctggtggccgagcaaacatgaatgttggagttgcccacagtgaggtaaaccccaatactcgtgtaatgaacagccgtgatacgtggctgacatatgctttgggagttggccgcttcctattgtattactcagcatccccttctgtagtgtccctgccgcctggaccttaacaaacataatacgtaatctggttgtatctggaggtgttgcaagtgacttgtacacccgaaaagcactggaaatcatcgcaaatgcagcacagtgcacgttgttgtgccccccctccaggactgtgcactgacaatggcatcacggctacatggaatggaactgaaagagtacgtgctggcttgggcgttttacatgatgtagaagacatccgaaatgaaccaaagtgtcctcttggactagacatatccagaggagttgcagaagctgccataaaagtaccacgattaaaatggcactttgatttgtgattttaaaggtctctacaggccataactgccatgcaactcaattccatatgaaactatgggaagaaaatctattcagtataaacaactttcattccaacaacataaattccatcccctgaagatactgtgtattttcccacaataaacaataagttttgaaaaaaaaagagtcaagaatcataaaaaaaaataaaaataaaaaataaaaaaagaatgtagatcaagcttaccaacgaaacattaaacttcaaaaactggccaggctgagatacagctcagtggtggggcttgcccaggatgcccaagccccagggtgcgatctccaacacctgggaaacctggccaaacgagtcagtgtaagactctatccacggcagagcaagtatgtccaggaatgatggtgcacacatgcagtccctgttcctcggggggctagggtaaggggattccagagttcaaggccagcttgaagaatacagcaagatccaatctcacaatgggaaaacaaaaatcatcatccccaaagcagaaaaacagtctaggaactaatttaggtttcacttacattttaaagtacaattaaaataacctagcagcattaagcctcccttcccactgttacatggtttgctgctgggatagcggctccctgtgtatccatgctagcctggaacttgtaatctacctgttttagctttctgagtgctagaattactgccaatcaaggagtttgaaatgagctgggagttggtgcacgcctttaatcctagcacttgggagggaggcagaggcaggtggatctctgtgagttcaagaccagcctggtctacagagtgagttccaggacaaccagggctacacagagaaacagtgtcttgaaaaagaccagacaagataacaaaagcagacatttgaaatgagttgcaatcacactcaggaggaatgatgaaagaagtattgtccatttttaaatgttaaagtggtcttaaaactgacttaacgtttttaagcactatagaacaaaccacattttagttatgtaggagctggctctaggtgcaagactcatcaccaaaagttgtacaactgcaaagagcatgtctggcagttcccagggagtccttaccatatagtagccagtgtggtagccactcatgtaccaagagattagcatactgcccagggcatcagtgtcatccagacagtcgggagagatgggagggggtggcgggattatctgcaaatggaaaaaatccacttaggattagggaaatactgaaacccagggattcactttacacagagaataatgaattattaactgaaccttttcctaaactcaatgagatacttctatttaatttttgaatctagcactggaagaaagccaaccataataagaaaaggccagggctggcaagatggctcagccggtaagagcactgactgctcttccgaaggtcctgagttcaaatcccagcaaccacatggtggctcacaaccatgtgtaatgagatctgacatcctcatctggtgagtctaaagtcagttacagtctacctatgtagaataataaatctttaaagaagaaaaaataagaaaagaccaacaaatctaacaaaaattaaaaccagttgacatttaatagtatgaatggactattttgttccattatgaagctatgcataagacacaaaacagagactcaagtctttccacaaacacaaacacaaacacacacacacacacagtatttttaaggacaccataaggaaagatttagagtagaacatctgcctgtctcccactcaaatacagtctgcccccaaatatccttttaactactgttaatatctaaaaataaaactactataaaacttctattagggccaagcagtggtggcgcaggcctttaatcccagcactagggaggcagaagcaggcagatctctgtgagttaaggcccaacctgttctaggacagccagggctggtccacagagaaacctggtcttgaaaaccaaacaaaccaaaaacctccattaggatgaaaacaaacaatgacaagaggcaagcccctgagaaagtacaggctcggagactctcattcaagtactccaagggacatagtatctgtcgcctctgtatactgaggacagtcctttctaacagaaaccagcagcaggaaactggataccaaccagtgaggggggaaccacaccaagcagagcttggcagtgagactgggagagaccatctgggtaacagagggccttccagacaaaaccagaggtttacatttttactcattagaatccaaccttaggggtggcctaaggtaacgcactccaattacctatattctaaaacaattactaactgtatataaaagtgtaacctcagctcttgtgtacttactggtggtcctgaagggaacgggggcatccagcacggcaggaaggggggagggggtagtggaggcggcggcggcgggccgttgaattttagacctggctataaagaatatttccaagttagtatcttaaggaaaaatcccttccgtcactgaaagaaagagtattcaaaaccaatgtaagagaagtaagaactggagagatggctcagcagttaacggcatctgcatcatatgtactagcccacacacagacatgtacacatatacgtaactacaaatgaagcaaatcttaacgcaaatcgtacattgttttccgttgcttttctatataaacatttagaaagtaaaatcacagtaaagatctgtaatgactcagtcgaccagagacaatgtatttaccaagatagtctaatcacaggaatacattcttcccccactatcacatatttttgtagatatcctgttactgggtccacaagacggctcagcagataaaaggtacttgtgggcaggactggcggcctgagttcaactcccaggacccacgcaaaggaagagaacccacttccatacgttgtccttttacttccattaagtatacagtacccaccccaaataaataagtgtaaactgaggaaagaaaaagttttagagattctgttacttatatatgctagagtacattgtaaaaactaccaaaaagacaagatatattttatagaatttgatcactccagattcaagaaactctaatacaatgtaacctttttttgtttgtttttttttttttttgttttgttttgagacagggtttctctgtatagctctggctatcctggaactctgtagaccaggctggccttgaactcagaaatccacctgcctctgcctcccaagtgctgggattaaaggcgtgcgccaccacaacctggcaaaatgtaacctttttttttttttaaaaagatttatttacttattatatgtaagtacactgtaggtgtcttcagacacaccagaagagggagtcatatctttttacggatggttgtgagccaccatgtggttgctgggatttgaactcgggaccttcagtagagcagtcagtgctcttaaccactgagccatctcaccacccagcacaatgtaacctttaattagaaaattatcacagaaaatctttggttgtttaaattttctaaaacattaattaatttagttgtgtgcacatgcatgtatggagcattgtcttagtcagggtttctgttcctgcacaaacatcatgaccaagagcagttggggaggaaagggtttattcggcttattcttccacattgctgttgatcaccaaaggaagtcaggactggaactcaagcaggtcaggaagcaggagctgatgtagaagccatggaaggatgtcttactggcttgctttccctggcttgctcagcctgctctcttatagaatccaagactaccagcccaggaatggtcccacccacaaggggtctctcccccttgatcactaattgagaaaatgccttacagctggatctcatggaggcatttcctcaactgaagctcctttctctgtgataactccagctgtgtcaagttgacacaaaactagccagtacaagtgtgtaccacagtgctcatgtggaacccagagacaacctttgggaatcatttttctctctctaccaagagactgcagggaactcgctcaggccggcgggctggcagcagatgcctttacccacggcaccaccttgcatcagttgttttcagtttacgttttagttttgtctttttttttttttttttcaaaactgtctctatggaggccaggctggtcccaaactcagtaatcctctcctcgccgtatctccagtgctcacttctactctactcacttctcagagaaagcctgaagaggtgctatacttaatttttacaaattactatctaggggtgaaaagagaggcctgagcttgggtccccagcacccacatagcaacaaggcaaggcagaacatattcttagccctagcactggggagatggagacaggatccctggggctctggcaggccaggctggctgaaccagcaagctccacgttcactgacacgatctgccccagaaaataaggtagagagtgattgaggaagatgctcagtgtagacctctggctgccactggcactagttccttcccacatacagcacacatatgcacgcgcacacacacaaacatgcacgaattatctaaataccatgccctctaagggaaaatactgctacttagtacaaaacaaacaacaaaacacaacaagctagttaaggttcttctagccataacctagcttataatacaattcttcttaagttgacttctactacttacaaccaaaagagccatacaaagtgttcacactttaaccctgtactatgctctgggataaacaaggtgtggtggctggcacattcctgtaatcccccatcatttatagatggaggaacgaggatgtgtggaagtcagaagccagcttataagagcagctctttccttcctctgtgtggtcctcatgcacacactatagtgtcataaaagtctgtaaaaaggaaagtgtaccagttacatgccagccagccatggcagtgcagggagcctcttacttcactgtgcgtttcctctttccagacgcaggcccggaagctcctggttcacaggaaagctatccattactcaatgaagagttaggctccccacactcattcctgcctacatatatatttttctcaacagaacatttacctttcctggtcctaatcctgaccctggcattgggggtggtggaggaagaaatgaggtccacggagcagctttggacttgctgtgtgctttacttctgagcgatctggaggagtgttcactgtcgtctgtggaaacttgactttcattctttaaaaagaaaaggaaacattgtattatgcaaaggcagggcaccgacaagcattcctatggccccgaccttgcgttccagcaaaaggagaaccagagagaatgagaatgtcattcaacgccttcgtgcgtcaacgtgacaactgattctaatgctttttccttacttagtgtccactttcaggaatggacatctttcggggcctcacctcctgagtgttctgttctgtactattagctacttcacaggtcggggaaagtaggtcagataagttttgctcctctctgtttccatatccagtataaaccacgacacaggtttctctcttaaagtcaatggacgtaatagtagctgggtaaatgcagccgtcttctgaccaaacagcagaacacttgtcaccaactttccactacaaaagaaaagaaagttatggacacgcaacattccttcttctgaaaagaacaaaccataacccagttctccaagtgtaattccagtcctcccattcacttcattataaacactgttcttagtcacctgcatctccttttcccggcctgatgaatggctataatgtattccaccaccgaaacgtgtcattaagaacaaaagagaccaaacgtgtatgacaaatccagtgttcttagtcaaagaaaagcaagtgttcaccaaatgtagacaccctttccctttggaaataatgaatggaaggaggcatcaaactattcactttacaaaaaaactcagagagagagagagagagagagagagagagagagaaaagaagagaggagagaatgagacctctagtctatagggttttgtgctgactcaatgtgggtctggtcagggacacacaggcacacaggctgggcctgtaaccagccaggtactttgctggtacactatacccccaggtcttctgctttcaatagcagacccagttaccacaagttttgagttaccctagtaatttttataattgttgaacttgtgtgtgtgtgtggggggggggggggggttgagttgcatatcagctacacagcacatactcagaatgcagagagctctggttttaatgcccagcctgcacatgtgtgtgcgcacacgcctgtgtgtgtatgtgtgcgtttgctaattcatccacagctctgggacactccaaacagaagcagcatgccgcccctcaggccgggcaggaccctggttaaatcaatctatcacctgtttcaagggagttgtggcattcttcttttggcttttattcttcttggcaggttttcttctggctgtgccttttggcttatctggagtttcacaaatgtcaccgttctttagagcatgctatgaaaacagtaaataaataaataaataaataaataagatctatgtgtcatggagggatatatttttaaaaagtcactactttctaacataacaggtcccaccacctaagaaagcctcaatgtgctcaagtttatttttcttctctctctttctttacaaaatgtatgacctgaggaaataaggaaaaaaatgattaaccatttcataccttaaaggaagccacagctttatcataagcttttatcaatgctgtatcatcccaaatgtcagaatcatcactctgaagagggagaaaaaataaaaaataagttatagatagatgtgcttaataaaaaacagataataggaagtactggggaagtagctcaaagtccctagatcaacccccagcaatgcctacagcccagacactcagagtgtgtgttacaggcagatacatttctagaaagtcaccacgcacgaacacagagatcctagcacctaagaaagcctcaatgtactcagtagaagcagaggactgccaaggcaaaactggtctgggctatagtgggttcccagacagcatagactacaacataaaactctatcccaacaaacaaacaagcacaccaacaaacaaaaacaaaaccatgaactacaaattaaaatggctcatatctataatctacaatcccaatatcccggagctggagacagtagggttgccaagagctccaggccagtctagcatattgaattccaggccaatttaggttatggaatgtgtccctgattcaaatgggggcgggagggggggctgagacggggcaatctccttgagtttgatgccagcctggcttacatggagagttccaagtctcctaaggctaccctgtgagacctgtctcaaaacaacaaaacagcaacaagaaagaagctgcaatcaataagattacccctgagattgtaaacatgacccatcaccctgggcatgaagaagttaccacgatgacaaattagcacaggaaccttgtggttttaaggagagaaccagaccgccagggctcccctgaggacaaagggcaaagctttattcagaataggaattgctgggctgtcccccaaagaaggaaatgcagcactgcccaaagctgcccagaattctcttctcccaccccaagccccaagcagaaatcagttgccataccataagacgaccgaggtcctaatgttttaaacttcgttagatggagtatgttgtttcccaggctagactcaacttcacattcctgcctcaggagctgggactgatcacatgcacagtccaccaacttggctctgatttgccctcgtacttaccagtgtttatcttacttctacagtctccctgtaatttaggctggtccggaattcacgctgtaaccgaggatcttgaactcccgaccctccggcccccatctcccaagtgtttgtgcatgtaattatgcgtgcaccaccaaccctgcctcggatctgctgtcgtatacatttgaatgcaatgcagtcaatagcaactttcaactactccgggcaactttagttatccctctctctcaaactttatcaactgttgtttgcaacacttggtctttccggttacaaaactggatccagaaaaccagcattttagtctaaagtccctgtgaacatcttcatcctgacctaaatctggagctttccaatggctcctatctggttgccttgcttcagccagcctgtccccgttcctgcacatcccctcacagtcacacaggaccaaagcgtggctcacagcctcgccggcgcccgagctgcaccaggagccgcctgcggatgtggcccgagctcgcaccgcctcggtctcgggcagcgctccgagtgctagcgccgagccgcgacctcacctggccggtgccacgccggaacagcaccgtatcttcctgctcggagcccgctccgccactgcccatcgccatggcctgctaccacggacgctgccgggctcactcaatgacgacttccgtcatggggcttctgggaccggaagagtacggtggcccggaggcagccagagacctcctacacgcttccaactcactcctcccacatctgtcttttctctttctcccctccacctgtcttctagttcttttttttttttttaacctttccctctgttttcttccaatttattttcctccctccagcccttttcttttcatttttcaagtcagcctcgctatatagcctaggctggcctttgctacctcagcttcccgagtttgggatgaaccttcacaataagggcatcctgtgtttgctggttcttgatgcacacaccaattattagacgatgggttggtatcgggccttttgcagtgttaggtgtctgttttgtaatgggcccaaggttgaggtaaggggagtcgaccatttccttcatctggcatatctggtaaattcctgagtctgattttcctgatagaatttcgatatcccatgtgccaccatagttttgatttatcccaataaatttacagattgactcaggaataagccacctatcagcctgtagaaaacaaacaaaaaactagataagtcctggcagatggtgctatttctggtgtacccagaggtttcagtcacctccctcaagatggagtcagaagctgcttgtagggtggagtttccagaggcaagcaggtatgagttggggccagcctggtctacatacgaagttccaggccagtcagaggtttgcagcgagcccctgtctcaaactatgatggactctcccagggcagggcacagcctggcaaaacccactgttttctacaatttaggggatcttggaatagggcatagacaatagggcatcccaaaagcgcccagtgagatttgtgggttcttgtgttccaggatttaacaaaataaaattggaccaggggcacactgatagtgatgtgggtgtagatcgtttgttaagagaatgttcccagctgcggacatggacagagtatctgggaaacacatcctactgagctggtaaaaggcagagtgccttagctaaattaggggatatttacccaacagaacactgaaacaatgtctcaaaaccacaaaaacctgcaatttaaaaaaatgaggaggcggtgacatcttcggctccagaaaaccggccaccttcctggccaaagcaacacagcttctgggaaagatcctgttttgggccttcatcttcagccaggaggaggtccaaacaccagataactgtgcaccttccctaaaagaggagagcttgcctgcagagactgctctgaccactgaaactcagaggagagagctagtctcccacgtctgctagtagagggtaacaaaatcaacagaggaacaatctctaaacaaagacaactataacaactaactccagagatagccagatggcgaaaggtaaacgtaagaatcctactaacaggaaccaagaccactcaccatcatcagaacccagcactcccacttcgcccagtccagggcatcctaacacacctgaaaaggtagacctggatttaaaagcatttcacatgatgatggtagaggacataaagaaggaatttaataactcacttaaagaaatacaggagaacactgctaaagagttacaagtccttaaagaaaaacaggaaaacacaaccaaacaggtagaagtccttatagaaaaaccggaaaacacatccaaacaggtgatagaaatgaacaaaaccatactagacctaaaaagggaagtagacacaataaagaaaacccaaagtgaggcaacgctgaagatagaaaccctaggaaagaaatctggaaccatagatgccagcatcagcaacagaatacaagagatggaagagagaatctcaggtgcagaagattccatagagaacatcggcacaacaatcaaagaaaatggaaaatgcaaaaagatcttaactcaaaacatccaggaaatccaggacacaatgagaagaccaaacctacggataataggagtggatgagaatgaagattttcaactcaaaggaccagcaaacatcttcaacaaaattattgaagaaaacttcccaaatctaaagaaagagatgaccatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaaccctatcagaattacactagatttttcaccagagacaatgaaagccagaagagcctggacagatgttatacagacactaagagaacacaaattccagcccagactactatacccagccaaactctcaattaccatagatggagaaaccaaagtattccacgacaaaactaaattcacccattatctctccacgaatccagcccttcaaaggataataacagaaaaaaaccaatacaaggacgggaaccacgccctagaaaaaacaagaagataatccctcaacaaaactaaaagaagacagccacaagaacagaacaccaactttaacaacaaaaataacaggaagcaacaattacttttccttaatatctcttaatatcaatggtctcaactccccaataaaaagacatagactaacagactggctacacaaacaagacccaacattctgctgcttacaggaaacccatctcagggaaaaagacagacactacctcagagtgaaaggctggaaaacaattttccaagcaaatggtctgaagaaacaagctggagtagccattttaatatctgataaaatcgacttccaacccaaagttatcaaaaaggacaaggagggacacttcatactcatcaaagataaaatcctccaagaggaactctcaattctgaatatctacgctccaaatgcaagggcagccacattcattaaagacactttagtaaagctcaaagcacacgttgcatctgacacaataaaggtgggagacttcaacacaccactttcatcaatggacagatcgtggaaacagaaactaaacagggacacagtgaaactaacagaagttatgaaacgaatggacctgacagatatctacagaacattttatcctaaaacaaaaggatataccttcttctcagcacttcacgggaccttctccaaatttgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaacaacactcttctcaatgataccttggtcaaggaaggaataaagaaagaaattaaagactttttagagtttaatgaaaatgaagccacaacgtacccaaaacctatgggacacaatgaaagcatttctaagagggaaactcatagctctgagtgcctccaagaagaaacgggagagagcacataatagcagcttgacaacacatctaaaagctctagaaaaaaaaaggaagcaaattcacccaagaggagtagatggcaggaaataatcaaactcaggggtgaaatcaaccaagtggaaacaagaagaactattcaaagaattaaccaaatgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccatctacacagtcccatatcacctaaagaaatagaagcagttattaatagtctcccagccaaaaaaagcccaggaccagacgggtttagtgcagagttctatcagaccttcaaagaagatctaattccagttctgcacaaactatttcacaaaatagaagtagaaggtactctacccaactcattttatgaagccactattactctgatacctaaaccacagaaagacccaacaaagatagagaacttcagaccaatttctcttatgaatattgatgcaaaaatcctcaataaaattctcgctaaccgaatccaagaacatattaaagcaatcatccatcctgaccaagtaggttttattccagggatgcagggatgatttaatatacgaaaatccatcaatgtaatccattatataaacaaactcaaagacaaaaaccacatgatgatctcgttagatgcagaaaaagcatttgacaagatttgacaacacccattcatgataaaagttttggaaagatcaggaattcaaggcccgtaccttaacatgataaaagtaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaataaactcaaacgagtcaatggcctttctctatacaaagaataaacaggctgagaaagaaattagggaaacaacacccttctcaatagtcacaaataatataaaatatcttggcgtgactctaactaaggaggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaagtcttctcaaggataaaagaacctctggtggaatcaccatgcctgacctacagctttgctacagagcaattatgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggtggttatcatgtagaagaatgcgaatcgatccatacttatctccttgtactaaggtcaaatctaagtggatcaaggaacttcacataaaaccagagacactgaaacttataaaggagaaagtggggaaaagccttgaagatatgggcacaggggaaaaattcctgaacagaacagcaatggcttgtgctgtaagattgagaattgacaaatgggacctaatgaaactccaaagtttctgcaaggcaaaagacaccatcaataagacaaaaagaccaccaacagattgggaaaggatttttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcaaaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactactggaggatccagcaatacctctcctgggcatatatccagaagatgccccaactggtaagaaggacacatgctccactatgttcatagcagtcttatttataatagccagaagctggaaagaacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataaggggatattagccccaaacctaggatacccaagatataagatacaatttgctaaacacatgaaactcaagaagaatgaagactgaagtgtggacactatgcccctccttagaattgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatcccggggcctagcaaacacagaagtggatgctcacagtcagctaatggatggatcacagggctcccaatggaggagctagagaaagtagccaaggagctaaagggatctgcaaccctataggtggaacaatgttatgaactaaccagtaccccggagctcttgactctagctgcatatgtatcaaaagatggcctagttggccatcactggaaagagaggccctttggatttgcaaactttatatgccccagtacaggggaatgccagggccaaaaagggagcgtgggtgggtaggggagtaggggtgggtgggtatgggggacttttggtatagcattacaaatgtaaatgagctaaatacccaataaaaatggaaaaaaaataaaaataaaataaaaattaaaaaatgaacgtgtaagttaaaacctgtatgaagttttaaataatttttcaatttaggctttcatagaatataagatgtttgtcattctgcttcttcagtggtttttgttgtcttgagacagggttttgatacgtatcccagcctcaaatttgttatcatcctattgcatcagcttttcctgggattgggagcatttactaccaagtttggtttcagtggctcttaggcatgggctaccatgtataagcttatctcagctgagcttaggcagtgaaggagttggaaaacagaaagctggtgataatgttatagaataagggggtccagtggagtggagtcaaccagagcctagagtgctacagagggcaaagctggaaaagtgacaccagccatttggaggagcccagaagatcacgtgtagatcccagacaatggaacaagaagctgtgaagctgaagttgacgtggagaccccaagatattcaagatgccagagccatgggatacctgctgaggaaaccagctaacagggagtggaaccagcccaggaaaaagaactttaccacagtcaacaaagatgaaaaaggagttggagatctcaagacggctttgacatcagatatggagattcagagtttggagttggcccaatggtttcctgtcttgctttgggtatttaagttaagtgattggatgaatctcagaagagactttgaaccttggacttttaacactgttgagactgctataaactatggagactttggaagttggactaaatgtgcttttaaattttgctatgtttaggcatggcccccatagactcatgcatttgaactggcctttggggaccagggagtggaatgtgatggtttgtatatgcttggcctggggagtggcactattaggaggtgtggccttattgaaatagatatgtcactgtgggtgtggactcctgccttgataatggactgaacctctgatcctgtaagccaatccaaattaaatgttggccttatgagagttgccccggtcatggtgtctgttcacagcagtaaaaccctaactaagacaaccccagtccctggtaccaacttctgttttaggattttactgctatgaacagacaccatgaagaaagcaactctcatacagataacatataattggggctggcttacaaattcagaggttcagtccattaccaagacagaagcatgtctttgtccaggcagccatgatgtaggatgagctgagagttctacatcttattctgaagacaaacaggagaagactggcttccagggagctaggatgaggctcataaagcctaagctcacagtgacacaccaacttcaacaaggccacacctccaaatgggtcaggcatattcaaaccaccacagtcgtgtgtgtgtgtgtgtgtgtgtgtgtgtgtgtgtgtgtgtgtgttgggggatggttttgtgcactgtgtattcagatgctcattaccatgcccagacatctggttgcaatctagatactggaattttcaagcatcttctgttacaacgttatgcaaaaattttccatcacgtccgattatttaataaagagccaatcagccaatggttgggtaggagaggaggaggcaggatttctgatcccagtgatcgtgtctctggtggggaccagaggagtttgatggggagtcaccatgaggatactgatggaggaggtgcagccaggtggagactaagatagcaagtaatggggcacggctgggtagtaggcagccatagacaggttagaatagggttacaataaatgagcatctgcccaggtataatgctacaagtttttcaataaatatagggcttccatgtccttatttgggagctagagcaggtagagaaaagccagactgacttccatatgaatgcaagtgcccacagaggccggaagtgtcagatcaccctggagttggagttaacagatagtttgagctgcctgacatgggtgctgggaacagaactccaggagctggaaactgtgctcagatcctgtgcaatacatgcttttaactgctgagtcacctgtcctgccccagtttgtttgaaacagtgtctcactctctggccccaaactcatgtcagtcatcctgctgaggcctcccgagtctgagattacatgtgtaagacactatacctggctcggttgttttaaattattatttaatttatttactcagttcaattctactcttgctgattcctcatttagtgcctacccatttagttgatcttcctggtttgttctagtgtaaattcttggagtgaagcagctggttacaaaccaacacttatatataaatggaacttctgtgtgtggtgttggaaactgaactagggcaagcaatgtaaagttgctatataccccaaccttatcagagaaaactggagataagggctcagctggtaaagaggaaaacaggagcttgacgatccgagctcagcttccagaagccacgttaagaagttgatgtggtgccacgcacctgtgctctgagctttcgtgctgcagtgggaggtggacatagaactgccgggaggacaatggagcagcagcaggaacacggcacgaggcagagggtaagaactaactcctcacatggaacccttgactcctcacgtgtaccctttgacctccactggggccatcaccacacatgcacgcacgtgcacagttaagggtgggcagtgaggtagcttagttgacagaggcacttgccaccatgctctgagttcaattcctgggagccacgtggtggaaggtgagcgatgactcccctaagtttaagaaaatgtataacaaacagaaagttaaagatctttaaggctagcactgtggctacacttatgatcttagaactcacatcccaaggcaggaggattgttaggtgtttaaggctagcctgggctacagaaagagattgtttcagaaaacaaaaacaaaaacacaaaattaaactacttaacgaagtctatataccaaaattctagattcacatgagagattctagtcctgaatcgcactactcattgttgcttacatctccagtatctcgcagagttcatagttcgagtgcttgttcctcagctggtggccttgttttgggaggctataggacctttaggagatggggctcactggaagaagtaggccattggggacaggactttgactgttaaccaggttcctgtccaggcatgaatttctgattcgatgtgaagagtagggtgtgctcctaccaccatgaaccgagcctctctgttctgttctcctttctatgaaggagtgaaatcctccaaaaccatgagacaatttgttcctcctcagctgatccttgtgaggtaccatggtcctagcaatgcaaatgtaagtattatattacctatttaataaattacattcatgttctcttttaataaaaataatattcaccaataatgttacatgcaaggtcagtactttattttttgatggtcttaaaacatcacattaagataggctgaagagtaaagtttaaaatagttttataaggacaagttataacacatataatgattagtcactgtgaaattttaatcttagagcgtatgatgcacccactggcaatagcacccaggttttccaaaaagccagtcatcatttttctgttgtctgcatagatttcttctcattggctatcttctgcttttgttgcatgatctctgaatccctgaaataaagaaaaggtatcaagttttcacaagaaaactgactcaatgctcttgttgtttcctatctataaccctcttggtacattcacagaagacatacacacccatgcttttccatttttatggatgtagacaaacagaaaagcaaagactggaaaagcattcaagtcagacctttgaatcatgctattgttatgacagccctgggaaaataatctcaaagttctttcatttggtgaaacgagagtctcactgtgtagccctggctgcccttgcactcaccatgcagaccatgctggcattcaactcagaggaatccacctgccattgcctctgtgcatgtaggaagtttcctacacacctaggactacaatatcaatgttacaaggcttgtagccagggatggtctttaagctgacacacagcccagaagacttggagctcttgatcctcttgcctccatttcctgagtgctggaattataactatccagtttttaaaagcctcaaatcaaatagtcaatgcttaaaatatgtggtatttgaagaaattttttaacccttttgtctccctggttgaatcttcatgtgtcatgtaagtatgaactaccaccagagctagatgatccatgagttagtgggacccatacttacacatatacttttaaatgtttttttaatatttagtggttgctgaatgaggtggtgcagtcccataacccaggctctcgggagggagaaacaggagggtcagaagtttcaggtctgactctatacacaggaagttccaggctaacctgggacagatgaatgcttatacatacatcctcttctttaaaaaaaaaaaaaaacaaaccctcaaaacagaaaacatagtatttaatgacactagacatcaaatccagggactcatccacaggtgtatgactccatatttttacatacactatataggtacgcattcagcatcctcaggcgagtgtggtggttcacccagtggttccaatacaggggaggctaagatcactaccaattctaggtagtaactattttcaactgttcaaaatagtgttacttcatgtccaaaaagtctttattgtttttatcatctttatgtgtctatttctttccaaaatttcaacttccaaccctattatttggagttttccatgtctttgtctccctctgctgttccgttcaggacactgcagtagtttctggttcttttattcatatgaggggcgtactgtagaaaaacaaacaaacaaacaaacaaaccaaaaaacagcggcttttgtgtttccaagctgggtgttttcctttgtctcctacgagtgaccttttttctattggaaaacttgcatgagtccagctccaagcccctgtgtggctggctcagggcatgggcctgaactgcaaccagcagcctatgtaccaattctaggcctcagccactgcagtgtaggtgactggaggagtggggcttggctgctcagggtcctacctagataggtggggtcaaggcaggtgctgcatttagaactgtgtctgactcatttcaggatcactgagctaacagaaactgaaggcaagctccttgctgtattagtaaagtcactggggctgtggaggtgtcttagttattaaagttcctgctgtgcaagcaccaggctctcagtttagaacctccacaaaattcacataaaaagcagggcacggtggtctgcatctaacctcagtgctggaagggcggggcttagacaggtagatcagtctgccaatctagccagagggatgagcttcttatttagtgagagatgctgtcaaaaatacaaggtggagagtgatgggggaaaagacacttgctaccaacctctggcctctacattccctcacacacacgtgtgtacacttataattacttgaagcacgcattcatgcatgcatgcacacacacacacacacacacacacacacgcacacgcacacacatacatataaacacaatgactatcataaaggaaaggaaagccgggcgtggtggcacacgcctttaatcccagcacttgggaggcagaggcaggcggatttctaagttcgaggccagcctggtctacagagtgagttccaggacagtctgggctatacagagaaaccctgcctggaaataaataaataaataaataaataaaggaaaagaaagtgatacttaaggtgtggaggtttctgtgactaccaaggcgagcaaagttaacaactgtgtgagataaaaaggccagtgtcagttcaaactttgagaatttacaactgggtaaatctaggcatatttaagtcagcaccatctggaaaaaagtttcctggtgataattaactcagtcccatgtacacaacaaagcttaagagctgtctacattaaaactcttagcagccgggcggtggtggcgcacacctttaatcccagcacttgggaggcagaggcaggcagatttctgagttcgaggccagcctggtctacaaaatgagttccaggacagccagggctacacagagaaaccctgtctcaaaaaaacaaaaaaacaaacccttttaggaaagtacaaatggcattttccataaagataggttatatagattaaccactgaaactggctcaaggtgaaccagctcatgaaaagggtctagaggataaagctacaatgttactgagacaaacaagctcaagataagtgggggcgggggagccactgtgtccgggccaca

SEQ ID NO: 9 - DNA, 32 bp, Homo sapiens
caatatgtcctctaagttggcatgtatagcta

SEQ ID NO: 10 - DNA, 429 bp, Homo sapiens
ggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatattt

SEQ ID NO: 11 - DNA, 44 bp, Homo sapiens
ctggttacagtttctactgttctctgcaagtaaataggcccaga

SEQ ID NO: 12 - DNA, 41 bp, Homo sapiens
atattggtataattgtaaataatgtcaaactccattttcta

SEQ ID NO: 13 - DNA, 27 bp, Homo sapiens
cataaccacaatgacattgaagcacag

SEQ ID NO: 14 - DNA, 4032 bp, Homo sapiens
cttcacctccccactgatcaaaacgagatgatagtttgccctcttcaaaagaaatgtgtgcatgtatatatctttgatttcttttgtagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagaggtaaggatacaaaaaaaaaaaaattcaatttctggaagcagagactagatgagaaactgttaaacagtatacacagttgtcagtttgatccaccgaggcattaattttttcttaatcacacccttataacaaaaacctgcatattttttctttttaaagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaaggtaaaccttctatgaaagttttccagaaaatagttaatgtcgggacatttaacctctctgttaactaatttgtagctctcccatgaaacttttgtagcttaaatacacaagaattttttgaaaaggaaataagataatgatgcaaaatagttaattttttaaaaaaatgttagacactgcagtggatgcaacaaaatactttatatgaaagatttatccagttaacttttgtggagtattaggtattagactaataattagcacacttacttaagttagaaagtataataatgcgccggacgcggtagctcacgcctgtaatcccagcactttgggaggccaaggtgggcggatcacaaggtcaggagatcgagaccatcctggctaacacggtgaaaccccatctctactgaaaatacaaaaaaatttgccgggcgtgatggcgggcacctgtagtcccagctactcgggaggctgaggcaggaggatggtgtgaaccccggaggcagagcttgcagtgagtcaagatcgtgccactgcactccaacctgggcgacagaatgagactccatctcaaacaaaaaaacaaaacaaaacaaaaaaaagtgtaataataatttatcattagctggatgatatgctgttgtttcccatgtcacctgtataagatatgtaaaataagaacacattatttacatctaatatagataaaatcctgaggcgctctcagattgttttgtagagttcaaatgtaaatattgttttcatttatggtccttttggttataagtaacagaaatcaactctaaaaagatttttattataggttagattatgtcatggaaccttaaggcttgtccctttctagttcttttgtgtaaagcggtgatttcttccatggagggaatggtatttaggcaattttttttttttttcgagatggagtcttgctctgtcgctcaggctggagtgcagtggcaccatttcagctcactgcaacttccacctcctgggttcaagtgattctcctgcttcagcctcccaagtagctgagattacaggcacccgccaccacacccggcttattttgtatttttagtagagatggggtttcaccatgttggccaggctggtcttgaactcctgacctcaagtgatctccccaccttggccttccaaagtgctaggattacaggcgcctagcctaggcagtcattttcaaaaaacaagcatgactcaccaaaagttttaagattttctgtgataatgttcttattgaggcttacattatattacagtttcttgaatctaaaatgatgtaccctcttaggatatatacatcatgcttcattggtctcagggggctgatttttataaggagagatttgctagttttcacaatatgtcctctaagttggcatgtatagctaaacaggctttcataaaaatatacaatttagttaatgaaatttgggatatagtcttttatgattgaaataattttgctaaatagactgtctctgatttattaggtaatcaccactcttattttgttttacttccttaatgtctacatagaaaggaaatgagaaaaatccagaggttgtcatttgacttatgagtctgtttgacttcaggatttggtacatgaaatttcacttaatctttttgatatgtataaaacaaatattctgggtaattatttttatccttttggttttgagtcctttttattcctatcatattgaaattggtaagttaattttcctttgaaatattccttatagccaggtctaaaattcaatggcccaccaccgccaccgccaccaccaccaccccacttactatcatgctggctgcctccatttccttctggaccaccagtaagtaaaaaagagtataggttagattttgctttcacatacaatttgataattagcagaatagaggattgtaaaatgtcattgtagaacatcccttgggccagattctaatgggtagaaatttgaactaaacctctgggttttgtttgtttttaatgcctttctgttacccagatgcagtgctcttgtagtcccaagtctaagctctaggttgccttctttcctggcagaagttggtgtctatgccataaggaggtagttcctgttagaagggatttaattataccttatataaggaattagtgtttgcccttctaggtatagttggatgttagcttctgatgtaaactggatttctttttctttctctctctttttttttttttgttttggaggcagagttttgcccttgtaccccaggctggagtgcagtggtgtgatctcagctcacagcaacctccgcctcctgggttcaagcaattctgcctcggcctcccaagtagctgggattacaggcgactgccaccacacccggctaatttttgttttattagtagagatggggtttcaccatgttggccagactgatcttgaactcctgacctcaggtgatccacccgccttggcctcccaaagcgctgggattacaggcgtgagctgccgcacccagctgtaaactggatttctaatggtagatttttaggtattaacaatagataaaaagatactttttggcatactgtgtattgggatggggttagaacaggtgttctacccaagacatttacttaaaatcgccctcgaaatgctatgtgagctgtgtgtgtgtgtgtgtgtgtgtgtgtgtattaaggaaaagcatgaaagtatttatgcttgattttttttttttactcatagcttcatagtggaacagatacatagtctaaatcaaaatgtttaaactttttatgtcacttgctgtcttttcgtcctcgttaaatttaattttgttggtcttttgttgttattggttggttttctccaaatgctagctatgttaagaaatttaaggccaggtacagtggctcatgcctgtaatcccggcattttagaaggctgaggcaggaggatcacttgagctcaggagtttgagaccagtctgggcaacatagcaagacctcgtctttgtttaggggaaaaaaaagaaatttaagtaggagattatataagcaaaaatacaattaatttccagcattcactatataatataaatctccagactttacttttttgtttactggatataaacaatatctttttctgtctccagataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattactaaaaaataaaaataaaaaaata

SEQ ID NO: 15 - DNA, 4032 bp, Homo sapiens
ttcacctccccactgatcaaaacgagatgatagtttgccctcttcaaaagaaatgtgtgcatgtatatatctttgatttcttttgtagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagaggtaaggatacaaaaaaaaaaaaattcaatttctggaagcagagactagatgagaaactgttaaacagtatacacagttgtcagtttgatccaccgaggcattaattttttcttaatcacacccttataacaaaaacctgcatattttttctttttaaagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaaggtaaaccttctatgaaagttttccagaaaatagttaatgtcgggacatttaacctctctgttaactaatttgtagctctcccatgaaacttttgtagcttaaatacacaagaattttttgaaaaggaaataagataatgatgcaaaatagttaattttttaaaaaaatgttagacactgcagtggatgcaacaaaatactttatatgaaagatttatccagttaacttttgtggagtattaggtattagactaataattagcacacttacttaagttagaaagtataataatgcgccggacgcggtagctcacgcctgtaatcccagcactttgggaggccaaggtgggcggatcacaaggtcaggagatcgagaccatcctggctaacacggtgaaaccccatctctactgaaaatacaaaaaaatttgccgggcgtgatggcgggcacctgtagtcccagctactcgggaggctgaggcaggaggatggtgtgaaccccggaggcagagcttgcagtgagtcaagatcgtgccactgcactccaacctgggcgacagaatgagactccatctcaaacaaaaaaacaaaacaaaacaaaaaaaagtgtaataataatttatcattagctggatgatatgctgttgtttcccatgtcacctgtataagatatgtaaaataagaacacattatttacatctaatatagataaaatcctgaggcgctctcagattgttttgtagagttcaaatgtaaatattgttttcatttatggtccttttggttataagtaacagaaatcaactctaaaaagatttttattataggttagattatgtcatggaaccttaaggcttgtccctttctagttcttttgtgtaaagcggtgatttcttccatggagggaatggtatttaggcaatttttttttttttttcgagatggagtcttgctctgtcgctcaggctggagtgcagtggcaccatttcagctcactgcaacttccacctcctgggttcaagtgattctcctgcttcagcctcccaagtagctgagattacaggcacccgccaccacacccggcttattttgtatttttagtagagatggggtttcaccatgttggccaggctggtcttgaactcctgacctcaagtgatctccccaccttggccttccaaagtgctaggattacaggcgcctagcctaggcagtcattttcaaaaaacaagcatgactcaccaaaagttttaagattttctgtgataatgttcttattgaggcttacattatattacagtttcttgaatctaaaatgatgtaccctcttagaatatatacatcatgcttcattggtctcagggggctgatttttataaggagagatttgctagttttcacaatatgtcctctaagttggcatgtatagctaaacaggctttcataaaaatatacaatttagttaatgaaatttgggatatagtcttttatgattgaaataattttgctaaatagactgtctctgatttattaggtaatcaccactcttattttgttttacttccttaatgtctacatagaaaggaaatgagaaaaatccagaggttgtcatttgacttatgagtctgtttgacttcaggatttggtacatgaaatttcacttaatctttttgatatgtataaaacaaatattctgggtaattatttttatccttttggttttgagtcctttttattcctatcatattgaaattggtaagttaattttcctttgaaatattccttatagccaggtctaaaattcaatggcccaccaccgccaccgccaccaccaccaccccacttactatcatgctggctgcctccatttccttctggaccaccagtaagtaaaaaagagtataggttagattttgctttcacatacaatttgataattagcagaatagaggattgtaaaatgtcattgtagaacatcccttgggccagattctaatgggtagaaatttgaactaaacctctgggttttgtttgtttttaatgcctttctgttacccagatgcagtgctcttgtagtcccaagtctaagctctaggttgccttctttcctggcagaagttggtgtctatgccataaggaggtagttcctgttagaagggatttaattataccttatataaggaattagtgtttgcccttctaggtatagttggatgttagcttctgatgtaaactggatttctttttctttctctctctttttttttttttgttttggaggcagagttttgcccttgtaccccaggctggagtgcagtggtgtgatctcagctcacagcaacctccgcctcctgggttcaagcaattctgcctcggcctcccaagtagctgggattacaggcgactgccaccacacccggctaatttttgttttattagtagagatggggtttcaccatgttggccagactgatcttgaactcctgacctcaggtgatccacccgccttggcctcccaaagcgctgggattacaggcgtgagctgccgcacccagctgtaaactggatttctaatggtagatttttaggtattaacaatagataaaaagatactttttggcatactgtgtattgggatggggttagaacaggtgttctacccaagacatttacttaaaatcgccctcgaaatgctatgtgagctgtgtgtgtgtgtgtgtgtgtgtgtgtattaaggaaaagcatgaaagtatttatgcttgattttttttttttactcatagcttcatagtggaacagatacatagtctaaatcaaaatgtttaaactttttatgtcacttgctgtcttttcgtcctcgttaaatttaattttgttggtcttttgttgttattggttggttttctccaaatgctagctatgttaagaaatttaaggccaggtacagtggctcatgcctgtaatcccggcattttagaaggctgaggcaggaggatcacttgagctcaggagtttgagaccagtctgggcaacatagcaagacctcgtctttgtttaggggaaaaaaaagaaatttaagtaggagattatataagcaaaaatacaattaatttccagcattcactatataatataaatctccagactttacttttttgtttactggatataaacaatatctttttctgtctccagataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattactaaaaaataaaaataaaaaaataca

SEQ ID NO: 16 - DNA, 4429 bp, Homo sapiens
ttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtctcattcccctgaactaaccaatgttaataatggtatgcttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccactgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccaggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtgctgggattacaggcgtgagccactgcgcccggcagtctttccttcttttttttttttttttttttttttttaatgacatggggtcttactttattactcaggctggtctcaaacttctggcctcaagggatcttcccaccttggcctcccaaattgctgggattacaggcataagtcatcatgcctggctacaaacagatattttcaataagaggataaaagttcatttccccatactttgctaacatcaaatgttattaattcctaatagttttgccaaactgagaggaaaatggtatgttagtttttctgggttttctttctttttaattttttttcttttttattcatcgcaacactattcacgatttttttattttttattttatttatttatttttttttttttgagacaaggtctccctatgttgcccaggctggtcttgtacccctgggctcaaaggatcctcctgcctcagcctcccaaagtgctaggattacaggc

SEQ ID NO: 17 - DNA, 4429 bp, Homo sapiens
ttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtcccattcccctgaactaaccaatgttaataatggtatacttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccgctgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccgggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtgctgggattacaggcgtgagccactgcgcccggcagtctttccttcttttttttttttttttttttttttttaatgacatggggtcttactttattactcaggctggtctcaaacttctggcctcaaggaatcttcccaccttggcctcccaaattgctgggattacaggcataagtcatcatgcctggctacaaacagatattttcaataagaggataaaagttcatttccccatactttgctaacatcaaatgttattaattcctaatagttttgccaaactgagaggaaaatggtatgttagtttttctgggttttctttctttttaattttttttcttttttattcatcgcaacactattcacgatttttttattttttattttatttatttatttatttttttttgagacaaggtctccctatgttgcccaggctggtcttgtacccctgggctcaaaggatcctcctgcctcagcctcccaaagtgctaggattacaggca

SEQ ID NO: 18 - DNA, 4044 bp, Homo sapiens
ctattttgctgctatgcagcagttcagcctttttcactgttgtgtagcattctgttatatgaatataccataatttagttactctacatttcatggacctttgaattgctcccactttggggctgttatgaataatgctaccgtaacatttttgtatatcttatgatggtcttaaacacgctatctactgagtatatgccaggaatggaattgctgggtcatagggtgtgtgtctatacacacacatacacacattttttagtaggtaccatcaaacaattgcatttttgttgtttttgttttagtttgtttttaatgaccataccattttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtctcattcccctgaactaaccaatgttaataatggtatgcttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccactgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccaggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggt

SEQ ID NO: 19 - DNA, 4044 bp, Homo sapiens
ctattttgctgctatgcagcagttcagcctttttcactgttgtgtagcattctgttatatgaatataccataatttagttactctacatttcatggacctttgaattgctcccactttggggctgttatgaataatgctaccgtaacatttttatatatcttatgatggtcttaaacacgctatctactgagtatatgccaggaatggaattgctgggtcatagggtgtgtgtctatacacacacatacacacattttttagtaggtaccatcaaacaattgcatttttgttgtttttgttttagtttgtttttaatgaccataccattttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtcccattcccctgaactaaccaatgttaataatggtatacttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccgctgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccgggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtg

SEQ ID NO: 20 - DNA, 4041 bp, Homo sapiens
gctgggtcatagggtgtgtgtctatacacacacatacacacattttttagtaggtaccatcaaacaattgcatttttgttgtttttgttttagtttgtttttaatgaccataccattttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtctcattcccctgaactaaccaatgttaataatggtatgcttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccactgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccaggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtg

SEQ ID NO: 21 - DNA, 4041 bp, Homo sapiens
gctgggtcatagggtgtgtgtctatacacacacatacacacattttttagtaggtaccatcaaacaattgcatttttgttgtttttgttttagtttgtttttaatgaccataccattttaccaccagcaataaaggaaggttccattgctccataccagcattaggtattatcagtccttttatctttaaccatattggtgggaggtagtggtatctcattgtagtcttaatttacttccatatacttaatttaaatacactcaatttatatacacacacgtatactctctcagccttcagtaagccagtcccattcccctgaactaaccaatgttaataatggtatacttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccgctgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccgggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtgc

SEQ ID NO: 22 - DNA, 4027 bp, Homo sapiens
tatcagtccttttatctttaaccatattggtgggaggtagtggtatctcattgtagtcttaatttacttccatatacttaatttaaatacactcaatttatatacacacacgtatactctctcagccttcagtaagccagtctcattcccctgaactaaccaatgttaataatggtatgcttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggtgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccactgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccaggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtgctgggattacaggcgtgagccactgcgcccggcagtctttccttcttttttttttttttttttttttttttaatgacatggggtcttactttattactcaggctggtctcaaacttctggcctcaagggatcttcccaccttggcctcccaaatt

SEQ ID NO: 23 - DNA, 4027 bp, Homo sapiens
tatcagtccttttatctttaaccatattggtgggaggtagtggtatctcattgtagtcttaatttacttccatatacttaatttaaatacactcaatttatatacacacacgtatactctctcagccttcagtaagccagtcccattcccctgaactaaccaatgttaataatggtatacttctctcagtgctcatgcaaacatgcatacacacacatacacataaataaggggtgtgggaatgtatttgattctgagagctgctgtaacaaattaccacaaacttagtggcttaaaacaacagaaatatttctgttcacagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactgtcttgtcagtcatttctgtttacccttctgtctggagtgtatttgtgaagagtcccttataacttatgttttatggacatcagcacataaccacaatgacattgaagcacaggatcattagtctatattttattttattattttatttatttatttatttatttttgagatggagtcttgctctgtcgcccaggctggagtgcagtggcacaatctcggctcactgcaagctctgcttcccaggttcacgccattctcctgcctcagcctcccgagtagctgggactacaggtgcccaccaccacacccggctaattttttgtacttttagtagagatggggtttcactgttttagccaggatggtctcgatctcctgacctcatgatccacccgccttggcctcccaaagtgctgggattataggtgtaagtcaccatgcccagcccattagtctatatttttaagtaaacataccaattaagaaagaagccaaaaaccaaaattagccaggtgtggtggcacgtgcctgtagtcccagctacttgggaggctgaggtgtgaggatcacttgaactcaggaggcagaggttgcagtgacccaagatggtgccgctgcactccagcctgggtgacagagtgagaccctgtttccacaaaaagaaaaaaaaaatagccgtgcctgtacttcagtacttacaaatttaactttagtatagatgtacagtaatttattcaatcatttccttactcatagacaattaggatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttggtaagcaagagctgcaattcatggcatacacacagaccgggctgatcattggtatgatcaggagaataaagggaaggttgcggccaggtgtgatagctcatgcctgtaatcccagcactttgggaggccgaggcgggcagatcacctgaggtcaggagtttgagaccagcctgaccaacatggagaaactccgtctctactaaaaatacaaaattagttgggcatagtggcgcatgcctgaatcccagctactcaggaggctgacacaggagaaatgcttgaacccgggaggtgaaggttgcagtgagccgagatcgcgccattgcactccagcctgggcaacaagagcaaaattccatctcaaaaaaaaaaaagagaaggttccgggttttatgagaaagaacagtattacatactgttttggaagaaagctcattcacactagagcttgtgggagctagcaagctctgattggtgagcgatggtggtaggtaaaaccagtcttagagtcatggcagttcattttagcagctattaggtaaaactggtcttagggatacagaaggctggttcagcagttggacttgtggaaaatttaattcttgaagcagatgctgtgtgccccgaatgcttcttccccctggcccttcaactctgatttagttgagtatttcaagaatgacccaatttatgtaatcaactttcacaggtatacatgtcttaaactttaaacagatgttttgggttttgttgttgttgtttttgagacggagtctcactctgttgtccaagctggagtgtagtggtgtgatctcggctcactgcaacctccgcctccagggtcaagtgattctccagcctcagcctcctgaatagctgggattacaggcgcccgccaccacgcccagctaatttttgtatttttagtagagatggggtggggtttcaccatgttggccaggctggtcttgaactcctgacatcaagtgttctgctcacctcagcctctgaaagtgctgggattacaggcgtgagccactgcgcccggcagtctttccttcttttttttttttttttttttttttttaatgacatggggtcttactttattactcaggctggtctcaaacttctggcctcaaggaatcttcccaccttggcctcccaaattg

SEQ ID NO: 24 - DNA, 41 bp, Homo sapiens
agcatgatagtaagtggggtggtggtggtggcggtggcggt

SEQ ID NO: 25 - DNA, 44 bp, Homo sapiens
atgaaattaacatacttcccaaagcatcagcatcatcaagagaa

SEQ ID NO: 26 - DNA, 4041 bp, Homo sapiens
aacacagtgaaaccctgtctttacaaaaaaatacaaaaaattagacaggcgtggtggcaggcacctgtagtcccagctacctctgaggctgaggcaggagaatggcgtgaatccagaaggcagagcttgctgtgagccaagatcacgccattgcactccagcctgggcaacagagcaagactccgtctcaaaaaaaaaaaaaaaaaaaaaagaatttcatttttcatttatgaaaaattatcccatcttttccattccctacaatcaatttcaaatcagagattaaaacattatttagaaaaagtataatttcaattcaaaagtgtataatcaaaataatctaacaatagcatgaaagctttttaaaattaactaaaattatacttagggacaatgcaagagtaatttaagcctcagacagttgtatttttttatttttattttttagtaatataaagagagaagcaagtagtattttataaatttacaaaacaaagtcacataactacaaaaaaattgtcaggaaaagatgctgagtgattacttaccatataatagccagtatgatagccactcatgtaccatgaaattaacatacttcccaaagcatcagcatcatcaagagaatctggacatatgggaggtggtgggggaattatctggagacagaaaaagatattgtttatatccagtaaacaaaaaagtaaagtctggagatttatattatatagtgaatgctggaaattaattgtatttttgcttatataatctcctacttaaatttcttttttttcccctaaacaaagacgaggtcttgctatgttgcccagactggtctcaaactcctgagctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagcaagtgacataaaaagtttaaacattttgatttagactatgtatctgttccactatgaagctatgagtaaaaaaaaaaaatcaagcataaatactttcatgcttttccttaatacacacacacacacacacacacacacacagctcacatagcatttcgagggcgattttaagtaaatgtcttgggtagaacacctgttctaaccccatcccaatacacagtatgccaaaaagtatctttttatctattgttaatacctaaaaatctaccattagaaatccagtttacagctgggtgcggcagctcacgcctgtaatcccagcgctttgggaggccaaggcgggtggatcacctgaggtcaggagttcaagatcagtctggccaacatggtgaaaccccatctctactaataaaacaaaaattagccgggtgtggtggcagtcgcctgtaatcccagctacttgggaggccgaggcagaattgcttgaacccaggaggcggaggttgctgtgagctgagatcacaccactgcactccagcctggggtacaagggcaaaactctgcctccaaaacaaaaaaaaaaaaagagagagaaagaaaaagaaatccagtttacatcagaagctaacatccaactatacctagaagggcaaacactaattccttatataaggtataattaaatcccttctaacaggaactacctccttatggcatagacaccaacttctgccaggaaagaaggcaacctagagcttagacttgggactacaagagcactgcatctgggtaacagaaaggcattaaaaacaaacaaaacccagaggtttagttcaaatttctacccattagaatctggcccaagggatgttctacaatgacattttacaatcctctattctgctaattatcaaattgtatgtgaaagcaaaatctaacctatactcttttttacttactggtggtccagaaggaaatggaggcagccagcatgatagtaagtggggtggtggtggtggcggtggcggtggtgggccattgaattttagacctggctataaggaatatttcaaaggaaaattaacttaccaatttcaatatgataggaataaaaaggactcaaaaccaaaaggataaaaataattacccagaatatttgttttatacatatcaaaaagattaagtgaaatttcatgtaccaaatcctgaagtcaaacagactcataagtcaaatgacaacctctggatttttctcatttcctttctatgtagacattaaggaagtaaaacaaaataagagtggtgattacctaataaatcagagacagtctatttagcaaaattatttcaatcataaaagactatatcccaaatttcattaactaaattgtatatttttatgaaagcctgtttagctatacatgccaacttagaggacatattgtgaaaactagcaaatctctccttataaaaatcagccccctgagaccaatgaagcatgatgtatatatcctaagagggtacatcattttagattcaagaaactgtaatataatgtaagcctcaataagaacattatcacagaaaatcttaaaacttttggtgagtcatgcttgttttttgaaaatgactgcctaggctaggcgcctgtaatcctagcactttggaaggccaaggtggggagatcacttgaggtcaggagttcaagaccagcctggccaacatggtgaaaccccatctctactaaaaatacaaaataagccgggtgtggtggcgggtgcctgtaatctcagctacttgggaggctgaagcaggagaatcacttgaacccaggaggtggaagttgcagtgagctgaaatggtgccactgcactccagcctgagcgacagagcaagactccatctcgaaaaaaaaaaaaaattgcctaaataccattccctccatggaagaaatcaccgctttacacaaaagaactagaaagggacaagccttaaggttccatgacataatctaacctataataaaaatctttttagagttgatttctgttacttataaccaaaaggaccataaatgaaaacaatatttacatttgaactctacaaaacaatctgagagcgcctcaggattttatctatattagatgtaaataatgtgttcttattttacatatcttatacaggtgacatgggaaacaacagcatatcatccagctaatgataaattattattacacttttttttgttttgttttgtttttttgtttgagatggagtctcattctgtcgcccaggttggagtgcagtggcacgatcttgactcactgcaagctctgcctccggggttcacaccatcctcctgcctcagcctcccgagtagctgggactacaggtgcccgccatcacgcccggcaaatttttttgtattttcagtagagatggggtttcaccgtgttagccaggatggtctcgatctcctgaccttgtgatccgcccaccttggcctcccaaagtgctgggattacaggcgtgagctaccgcgtccggcgcattattatactttctaacttaagtaagtgtgctaattattagtctaatacctaatactccacaaaagttaactggataaatctttcatataaagtattttgttgcatccactgcagtgtctaacatttttttaaaaaattaactattttgcatcattatcttatttccttttcaaaaaattcttgtgtatttaagctacaaaagtttcatgggagagctacaaattagttaacagagaggttaaatgtcccgacattaactattttctggaaaactttcatagaaggtttacctttcctggtcccagtcttggccctggcatggggggtggtggagggagaaaagagttccatggagcagatttgggcttgatgttatctgatttatttccaggagacctggagttctcactttcatctgttgaaacttggctttcattttcattctttaaaaagaaaaaatatgcaggtttttgttat

SEQ ID NO: 27 - DNA, 4041 bp, Homo sapiens
ctaacacagtgaaaccctgtctttacaaaaaaatacaaaaaattagacaggcgtggtggcaggcacctgtagtcccagctacctctgaggctgaggcaggagaatggcgtgaatccaggaggcagagcttgctgtgagccaagatcacgccattgcactccagcctgggcaacagagcaagactccgtctcaaaaaaaaaaaaaaaaaaaaaagaatttcatttttcatttatgaaaaattatcccatcttttccattccctacaatcaatttcaaatcagagattaaaacattatttagaaaaagtataatttcaattcaaaagtgtataatcaaaataatctaacaatagcatgaaagctttttaaaattaactaaaattatacttagggacaatgcaagagtaatttaagcctcagacagttgtatttttttatttttattttttagtaatataaagagagaagcaagtagtattttataaatttacaaaacaaagtcacataactacaaaaaaattgtcaggaaaagatgctgagtgattacttaccatataatagccagtatgatagccactcatgtaccatgaaattaacatacttcccaaagcatcagcatcatcaagagaatctggacatatgggaggtggtgggggaattatctggagacagaaaaagatattgtttatatccagtaaacaaaaaagtaaagtctggagatttatattatatagtgaatgctggaaattaattgtatttttgcttatataatctcctacttaaatttcttttttttcccctaaacaaagacgaggtcttgctatgttgcccagactggtctcaaactcctgagctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagcaagtgacataaaaagtttaaacattttgatttagactatgtatctgttccactatgaagctatgagtaaaaaaaaaaaatcaagcataaatactttcatgcttttccttaatacacacacacacacacacacacacacagctcacatagcatttcgagggcgattttaagtaaatgtcttgggtagaacacctgttctaaccccatcccaatacacagtatgccaaaaagtatctttttatctattgttaatacctaaaaatctaccattagaaatccagtttacagctgggtgcggcagctcacgcctgtaatcccagcgctttgggaggccaaggcgggtggatcacctgaggtcaggagttcaagatcagtctggccaacatggtgaaaccccatctctactaataaaacaaaaattagccgggtgtggtggcagtcgcctgtaatcccagctacttgggaggccgaggcagaattgcttgaacccaggaggcggaggttgctgtgagctgagatcacaccactgcactccagcctggggtacaagggcaaaactctgcctccaaaacaaaaaaaaaaaaagagagagaaagaaaaagaaatccagtttacatcagaagctaacatccaactatacctagaagggcaaacactaattccttatataaggtataattaaatcccttctaacaggaactacctccttatggcatagacaccaacttctgccaggaaagaaggcaacctagagcttagacttgggactacaagagcactgcatctgggtaacagaaaggcattaaaaacaaacaaaacccagaggtttagttcaaatttctacccattagaatctggcccaagggatgttctacaatgacattttacaatcctctattctgctaattatcaaattgtatgtgaaagcaaaatctaacctatactcttttttacttactggtggtccagaaggaaatggaggcagccagcatgatagtaagtggggtggtggtggtggcggtggcggtggtgggccattgaattttagacctggctataaggaatatttcaaaggaaaattaacttaccaatttcaatatgataggaataaaaaggactcaaaaccaaaaggataaaaataattacccagaatatttgttttatacatatcaaaaagattaagtgaaatttcatgtaccaaatcctgaagtcaaacagactcataagtcaaatgacaacctctggatttttctcatttcctttctatgtagacattaaggaagtaaaacaaaataagagtggtgattacctaataaatcagagacagtctatttagcaaaattatttcaatcataaaagactatatcccaaatttcattaactaaattgtatatttttatgaaagcctgtttagctatacatgccaacttagaggacatattgtgaaaactagcaaatctctccttataaaaatcagccccctgagaccaatgaagcatgatgtatatattctaagagggtacatcattttagattcaagaaactgtaatataatgtaagcctcaataagaacattatcacagaaaatcttaaaacttttggtgagtcatgcttgttttttgaaaatgactgcctaggctaggcgcctgtaatcctagcactttggaaggccaaggtggggagatcacttgaggtcaggagttcaagaccagcctggccaacatggtgaaaccccatctctactaaaaatacaaaataagccgggtgtggtggcgggtgcctgtaatctcagctacttgggaggctgaagcaggagaatcacttgaacccaggaggtggaagttgcagtgagctgaaatggtgccactgcactccagcctgagcgacagagcaagactccatctcgaaaaaaaaaaaaaaattgcctaaataccattccctccatggaagaaatcaccgctttacacaaaagaactagaaagggacaagccttaaggttccatgacataatctaacctataataaaaatctttttagagttgatttctgttacttataaccaaaaggaccataaatgaaaacaatatttacatttgaactctacaaaacaatctgagagcgcctcaggattttatctatattagatgtaaataatgtgttcttattttacatatcttatacaggtgacatgggaaacaacagcatatcatccagctaatgataaattattattacacttttttttgttttgttttgtttttttgtttgagatggagtctcattctgtcgcccaggttggagtgcagtggcacgatcttgactcactgcaagctctgcctccggggttcacaccatcctcctgcctcagcctcccgagtagctgggactacaggtgcccgccatcacgcccggcaaatttttttgtattttcagtagagatggggtttcaccgtgttagccaggatggtctcgatctcctgaccttgtgatccgcccaccttggcctcccaaagtgctgggattacaggcgtgagctaccgcgtccggcgcattattatactttctaacttaagtaagtgtgctaattattagtctaatacctaatactccacaaaagttaactggataaatctttcatataaagtattttgttgcatccactgcagtgtctaacatttttttaaaaaattaactattttgcatcattatcttatttccttttcaaaaaattcttgtgtatttaagctacaaaagtttcatgggagagctacaaattagttaacagagaggttaaatgtcccgacattaactattttctggaaaactttcatagaaggtttacctttcctggtcccagtcttggccctggcatggggggtggtggagggagaaaagagttccatggagcagatttgggcttgatgttatctgatttatttccaggagacctggagttctcactttcatctgttgaaacttggctttcattttcattctttaaaaagaaaaaatatgcaggtttttgtta

SEQ ID NO: 28 - DNA, 4044 bp, Homo sapiens
tttaaaaaacacaaaagcctacagtgttacagtcagataactgatctcaaaacaaattacaagctgttgatttattactttttggtcattaaaatgaggaattcatgatacatacaatataccaaggttatactacaacaactgaagcgtgacttttttttccctccgcaaattctcactctgttggccaggctagagtgcagcggtgtgatctcggctcactgcaacctctgcctcccaggttcaagtgattctcctgcctcaacctctcaagtagctgggattacaactgcccgccactgggctaagttttgtgtatttagtagaaatggagtagtcaccatgttggccaggctggtcctgaactcctaacctcaagtgatccacctgcctctacctcccaaagtactgggattataggtgtgagccaccgtgccaggcctttttctttttttgagatggaatctcactctgtcaccaagggtggagtgcagtggcacaatctcaactcactgcaacctctgcctcccagattaaagcaattttcctgccacagcctcccaagtagctcggattacaggcatgtgccaccatgcctggctaaattttttttggtatttttagtagagacaaggtttcatcatgttggccaggctggtctcaaactcctgacctcaagtgatctgcctgcctcggcctcacaaactgttgggattacagttgtaagccaccatgtctggccttaacttttaaataagaatattaatgggggcacacacagatgatacatttaaaaacatacacctttaagtcagttgtttcttctatattaatttactaaaaatacaagtgcctacaatatcacatcataattttagcagggcacaagagcttacttttaaaaataattttaggccgggcgcggtggctcacgcttgtaatcccagcactttgggaggccgaggcgggtggatcacgaggtcaggagattgagaccacggtgaaaccccgtctctactaaaaataaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccgtctcaaaaaaaaaaaaaaaataaaataaaataaaataattttaaatgttctgactaaaatacaatagaacatgtccgtaggagactaacgtataaagtgacaagtttgaagccatactccccaaggttcaatgtggtacacattaccccagatctttgtgcattaaaaaaatttcatttctcttggaaggccgaggcgggtggatcacggggtcaggagattgagaccatcctggctaacacagtgaaaccctgtctttacaaaaaaatacaaaaaattagacaggcgtggtggcaggcacctgtagtcccagctacctctgaggctgaggcaggagaatggcgtgaatccagaaggcagagcttgctgtgagccaagatcacgccattgcactccagcctgggcaacagagcaagactccgtctcaaaaaaaaaaaaaaaaaaaaaagaatttcatttttcatttatgaaaaattatcccatcttttccattccctacaatcaatttcaaatcagagattaaaacattatttagaaaaagtataatttcaattcaaaagtgtataatcaaaataatctaacaatagcatgaaagctttttaaaattaactaaaattatacttagggacaatgcaagagtaatttaagcctcagacagttgtatttttttatttttattttttagtaatataaagagagaagcaagtagtattttataaatttacaaaacaaagtcacataactacaaaaaaattgtcaggaaaagatgctgagtgattacttaccatataatagccagtatgatagccactcatgtaccatgaaattaacatacttcccaaagcatcagcatcatcaagagaatctggacatatgggaggtggtgggggaattatctggagacagaaaaagatattgtttatatccagtaaacaaaaaagtaaagtctggagatttatattatatagtgaatgctggaaattaattgtatttttgcttatataatctcctacttaaatttcttttttttcccctaaacaaagacgaggtcttgctatgttgcccagactggtctcaaactcctgagctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagcaagtgacataaaaagtttaaacattttgatttagactatgtatctgttccactatgaagctatgagtaaaaaaaaaaaatcaagcataaatactttcatgcttttccttaatacacacacacacacacacacacacacacagctcacatagcatttcgagggcgattttaagtaaatgtcttgggtagaacacctgttctaaccccatcccaatacacagtatgccaaaaagtatctttttatctattgttaatacctaaaaatctaccattagaaatccagtttacagctgggtgcggcagctcacgcctgtaatcccagcgctttgggaggccaaggcgggtggatcacctgaggtcaggagttcaagatcagtctggccaacatggtgaaaccccatctctactaataaaacaaaaattagccgggtgtggtggcagtcgcctgtaatcccagctacttgggaggccgaggcagaattgcttgaacccaggaggcggaggttgctgtgagctgagatcacaccactgcactccagcctggggtacaagggcaaaactctgcctccaaaacaaaaaaaaaaaaagagagagaaagaaaaagaaatccagtttacatcagaagctaacatccaactatacctagaagggcaaacactaattccttatataaggtataattaaatcccttctaacaggaactacctccttatggcatagacaccaacttctgccaggaaagaaggcaacctagagcttagacttgggactacaagagcactgcatctgggtaacagaaaggcattaaaaacaaacaaaacccagaggtttagttcaaatttctacccattagaatctggcccaagggatgttctacaatgacattttacaatcctctattctgctaattatcaaattgtatgtgaaagcaaaatctaacctatactcttttttacttactggtggtccagaaggaaatggaggcagccagcatgatagtaagtggggtggtggtggtggcggtggcggtggtgggccattgaattttagacctggctataaggaatatttcaaaggaaaattaacttaccaatttcaatatgataggaataaaaaggactcaaaaccaaaaggataaaaataattacccagaatatttgttttatacatatcaaaaagattaagtgaaatttcatgtaccaaatcctgaagtcaaacagactcataagtcaaatgacaacctctggatttttctcatttcctttctatgtagacattaaggaagtaaaacaaaataagagtggtgattacctaataaatcagagacagtctatttagcaaaattatttcaatcataaaagactatatcccaaatttcattaactaaattgtatatttttatgaaagcctgtttagctatacatgccaacttagaggacatattgtgaaaactagcaaatctctccttataaaaatcagccccctgagaccaatgaagcatgatgtatatatcctaagagggtacatcattttagattcaagaaactgtaatataatgtaagcctcaataagaacattatcacagaaaatcttaaaacttttggtgagtcatgctt

SEQ ID NO: 29 - DNA, 4044 bp, Homo sapiens
tttaaaaaacacaaaagcctacagtgttacagtcagataactgatctcaaaacaaattacaagctgttgatttattactttttggtcattaaaatgaggaattcatgatacatacaatataccaaggttatactacaacaactgaagcgtgacttttttttccctccgcaaattctcactctgttggccaggctagagtgcagcggtgtgatctcggctcactgcaacctctgcctcccaggttcaagtgattctcctgcctcaacctctcaagtagctgggattacaactgcccgccactgggctaagttttgtgtatttagtagaaatggagtagtcaccatgttggccaggctggtcctgaactcctaacctcaagtgatccacctgcctctacctcccaaagtactgggattataggtgtgagccaccgtgccaggcctttttctttttttgagatggaatctcactctgtcaccaagggtggagtgcagtggcacaatctcaactcactgcaacctctgcctcccagattaaagcaattttcctgccacagcctcccaagtagctcggattacaggcatgtgccaccatgcctggctaaattttttttggtatttttagtagagacaaggtttcatcatgttggccaggctggtctcaaactcctgacctcaagtgatctgcctgcctcggcctcacaaactgttgggattacagttgtaagccaccatgtctggccttaacttttaaataagaatattaatgggggcacacacagatgatacatttaaaaacatacacctttaagtcagttgtttcttctatattaatttactaaaaatacaagtgcctacaatatcacatcataattttagcagggcacaagagcttacttttaaaaataattttaggccgggcgcggtggctcacgcttgtaatcccagcactttgggaggccgaggcgggtggatcacgaggtcaggagatcgagaccacggtgaaaccccgtctctactaaaaataaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccgtctcaaaaaaaaaaaaaaaataaaataaaataaaataattttaaatgttctgactaaaatacaatagaacatgtccgtaggagactaacgtataaagtgacaagtttgaagccatactccccaaggttcaatgtggtacacattaccccagatctttgtgcattaaaaaaatttcatttctcttggaaggccgaggcgggtggatcacggggtcaggagattgagaccatcctggctaacacagtgaaaccctgtctttacaaaaaaatacaaaaaattagacaggcgtggtggcaggcacctgtagtcccagctacctctgaggctgaggcaggagaatggcgtgaatccaggaggcagagcttgctgtgagccaagatcacgccattgcactccagcctgggcaacagagcaagactccgtctcaaaaaaaaaaaaaaaaaaaaaagaatttcatttttcatttatgaaaaattatcccatcttttccattccctacaatcaatttcaaatcagagattaaaacattatttagaaaaagtataatttcaattcaaaagtgtataatcaaaataatctaacaatagcatgaaagctttttaaaattaactaaaattatacttagggacaatgcaagagtaatttaagcctcagacagttgtatttttttatttttattttttagtaatataaagagagaagcaagtagtattttataaatttacaaaacaaagtcacataactacaaaaaaattgtcaggaaaagatgctgagtgattacttaccatataatagccagtatgatagccactcatgtaccatgaaattaacatacttcccaaagcatcagcatcatcaagagaatctggacatatgggaggtggtgggggaattatctggagacagaaaaagatattgtttatatccagtaaacaaaaaagtaaagtctggagatttatattatatagtgaatgctggaaattaattgtatttttgcttatataatctcctacttaaatttcttttttttcccctaaacaaagacgaggtcttgctatgttgcccagactggtctcaaactcctgagctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagcaagtgacataaaaagtttaaacattttgatttagactatgtatctgttccactatgaagctatgagtaaaaaaaaaaaatcaagcataaatactttcatgcttttccttaatacacacacacacacacacacacacacagctcacatagcatttcgagggcgattttaagtaaatgtcttgggtagaacacctgttctaaccccatcccaatacacagtatgccaaaaagtatctttttatctattgttaatacctaaaaatctaccattagaaatccagtttacagctgggtgcggcagctcacgcctgtaatcccagcgctttgggaggccaaggcgggtggatcacctgaggtcaggagttcaagatcagtctggccaacatggtgaaaccccatctctactaataaaacaaaaattagccgggtgtggtggcagtcgcctgtaatcccagctacttgggaggccgaggcagaattgcttgaacccaggaggcggaggttgctgtgagctgagatcacaccactgcactccagcctggggtacaagggcaaaactctgcctccaaaacaaaaaaaaaaaaagagagagaaagaaaaagaaatccagtttacatcagaagctaacatccaactatacctagaagggcaaacactaattccttatataaggtataattaaatcccttctaacaggaactacctccttatggcatagacaccaacttctgccaggaaagaaggcaacctagagcttagacttgggactacaagagcactgcatctgggtaacagaaaggcattaaaaacaaacaaaacccagaggtttagttcaaatttctacccattagaatctggcccaagggatgttctacaatgacattttacaatcctctattctgctaattatcaaattgtatgtgaaagcaaaatctaacctatactcttttttacttactggtggtccagaaggaaatggaggcagccagcatgatagtaagtggggtggtggtggtggcggtggcggtggtgggccattgaattttagacctggctataaggaatatttcaaaggaaaattaacttaccaatttcaatatgataggaataaaaaggactcaaaaccaaaaggataaaaataattacccagaatatttgttttatacatatcaaaaagattaagtgaaatttcatgtaccaaatcctgaagtcaaacagactcataagtcaaatgacaacctctggatttttctcatttcctttctatgtagacattaaggaagtaaaacaaaataagagtggtgattacctaataaatcagagacagtctatttagcaaaattatttcaatcataaaagactatatcccaaatttcattaactaaattgtatatttttatgaaagcctgtttagctatacatgccaacttagaggacatattgtgaaaactagcaaatctctccttataaaaatcagccccctgagaccaatgaagcatgatgtatatattctaagagggtacatcattttagattcaagaaactgtaatataatgtaagcctcaataagaacattatcacagaaaatcttaaaacttttggtgagtcatgcttgt

SEQ ID NO: 30 - DNA, 15 bp, Homo sapiens
agaattcttttagac

SEQ ID NO: 31 - DNA, 15 bp, Homo sapiens
gagaattcttttaga

SEQ ID NO: 32 - DNA, 15 bp, Homo sapiens
agagaattcttttag

SEQ ID NO: 33 - DNA, 15 bp, Homo sapiens
tagagaattctttta

SEQ ID NO: 34 - DNA, 15 bp, Homo sapiens
atagagaattctttt

SEQ ID NO: 35 - DNA, 15 bp, Homo sapiens
aatagagaattcttt

SEQ ID NO: 36 - DNA, 15 bp, Homo sapiens
aaatagagaattctt

SEQ ID NO: 37 - DNA, 15 bp, Homo sapiens
aaaatagagaattct

SEQ ID NO: 38 - DNA, 15 bp, Homo sapiens
caaaatagagaattc

SEQ ID NO: 39 - DNA, 15 bp, Homo sapiens
gcaaaatagagaatt

SEQ ID NO: 40 - DNA, 15 bp, Homo sapiens
agcaaaatagagaat

SEQ ID NO: 41 - DNA, 15 bp, Homo sapiens
cagcaaaatagagaa

SEQ ID NO: 42 - DNA, 15 bp, Homo sapiens
gcagcaaaatagaga

SEQ ID NO: 43 - DNA, 15 bp, Homo sapiens
agcagcaaaatagag

SEQ ID NO: 44 - DNA, 15 bp, Homo sapiens
tagcagcaaaataga

SEQ ID NO: 45 - DNA, 15 bp, Homo sapiens
atagcagcaaaatag

SEQ ID NO: 46 - DNA, 15 bp, Homo sapiens
catagcagcaaaata

SEQ ID NO: 47 - DNA, 15 bp, Homo sapiens
gcatagcagcaaaat

SEQ ID NO: 48 - DNA, 15 bp, Homo sapiens
tgcatagcagcaaaa

SEQ ID NO: 49 - DNA, 15 bp, Homo sapiens
ctgcatagcagcaaa

SEQ ID NO: 50 - DNA, 15 bp, Homo sapiens
gctgcatagcagcaa

SEQ ID NO: 51 - DNA, 15 bp, Homo sapiens
tgctgcatagcagca

SEQ ID NO: 52 - DNA, 15 bp, Homo sapiens
ctgctgcatagcagc

SEQ ID NO: 53 - DNA, 15 bp, Homo sapiens
actgctgcatagcag

SEQ ID NO: 54 - DNA, 15 bp, Homo sapiens
aactgctgcatagca

SEQ ID NO: 55 - DNA, 15 bp, Homo sapiens
gaactgctgcatagc

SEQ ID NO: 56 - DNA, 15 bp, Homo sapiens
tgaactgctgcatag

SEQ ID NO: 57 - DNA, 15 bp, Homo sapiens
ctgaactgctgcata

SEQ ID NO: 58 - DNA, 15 bp, Homo sapiens
gctgaactgctgcat

SEQ ID NO: 59 - DNA, 15 bp, Homo sapiens
ggctgaactgctgca

SEQ ID NO: 60 - DNA, 15 bp, Homo sapiens
aggctgaactgctgc

SEQ ID NO: 61 - DNA, 15 bp, Homo sapiens
aaggctgaactgctg

SEQ ID NO: 62 - DNA, 15 bp, Homo sapiens
aaaggctgaactgct

SEQ ID NO: 63 - DNA, 15 bp, Homo sapiens
aaaaggctgaactgc

SEQ ID NO: 64 - DNA, 15 bp, Homo sapiens
aaaaaggctgaactg

SEQ ID NO: 65 - DNA, 15 bp, Homo sapiens
gaaaaaggctgaact

SEQ ID NO: 66 - DNA, 15 bp, Homo sapiens
tgaaaaaggctgaac

SEQ ID NO: 67 - DNA, 15 bp, Homo sapiens
gtgaaaaaggctgaa

SEQ ID NO: 68 - DNA, 15 bp, Homo sapiens
agtgaaaaaggctga

SEQ ID NO: 69 - DNA, 15 bp, Homo sapiens
cagtgaaaaaggctg

SEQ ID NO: 70 - DNA, 15 bp, Homo sapiens
acagtgaaaaaggct

SEQ ID NO: 71 - DNA, 15 bp, Homo sapiens
aacagtgaaaaaggc

SEQ ID NO: 72 - DNA, 15 bp, Homo sapiens
caacagtgaaaaagg

SEQ ID NO: 73 - DNA, 15 bp, Homo sapiens
acaacagtgaaaaag

SEQ ID NO: 74 - DNA, 15 bp, Homo sapiens
cacaacagtgaaaaa

SEQ ID NO: 75 - DNA, 15 bp, Homo sapiens
acacaacagtgaaaa

SEQ ID NO: 76 - DNA, 15 bp, Homo sapiens
tacacaacagtgaaa

SEQ ID NO: 77 - DNA, 15 bp, Homo sapiens
ctacacaacagtgaa

SEQ ID NO: 78 - DNA, 15 bp, Homo sapiens
gctacacaacagtga

SEQ ID NO: 79 - DNA, 15 bp, Homo sapiens
tgctacacaacagtg

SEQ ID NO: 80 - DNA, 15 bp, Homo sapiens
atgctacacaacagt

SEQ ID NO: 81 - DNA, 15 bp, Homo sapiens
aatgctacacaacag

SEQ ID NO: 82 - DNA, 15 bp, Homo sapiens
gaatgctacacaaca

SEQ ID NO: 83 - DNA, 15 bp, Homo sapiens
agaatgctacacaac

SEQ ID NO: 84 - DNA, 15 bp, Homo sapiens
cagaatgctacacaa

SEQ ID NO: 85 - DNA, 15 bp, Homo sapiens
acagaatgctacaca

SEQ ID NO: 86 - DNA, 15 bp, Homo sapiens
aacagaatgctacac

SEQ ID NO: 87 - DNA, 15 bp, Homo sapiens
taacagaatgctaca

SEQ ID NO: 88 - DNA, 15 bp, Homo sapiens
ataacagaatgctac

SEQ ID NO: 89 - DNA, 15 bp, Homo sapiens
tataacagaatgcta

SEQ ID NO: 90 - DNA, 15 bp, Homo sapiens
atataacagaatgct

SEQ ID NO: 91 - DNA, 15 bp, Homo sapiens
catataacagaatgc

SEQ ID NO: 92 - DNA, 15 bp, Homo sapiens
tcatataacagaatg

SEQ ID NO: 93 - DNA, 15 bp, Homo sapiens
ttcatataacagaat

SEQ ID NO: 94 - DNA, 15 bp, Homo sapiens
attcatataacagaa

SEQ ID NO: 95 - DNA, 15 bp, Homo sapiens
tattcatataacaga

SEQ ID NO: 96 - DNA, 15 bp, Homo sapiens
atattcatataacag

SEQ ID NO: 97 - DNA, 15 bp, Homo sapiens
tatattcatataaca

SEQ ID NO: 98 - DNA, 15 bp, Homo sapiens
gtatattcatataac

SEQ ID NO: 99 - DNA, 15 bp, Homo sapiens
ggtatattcatataa

SEQ ID NO: 100 - DNA, 15 bp, Homo sapiens
tggtatattcatata

SEQ ID NO: 101 - DNA, 15 bp, Homo sapiens
atggtatattcatat

SEQ ID NO: 102 - DNA, 15 bp, Homo sapiens
tatggtatattcata

SEQ ID NO: 103 - DNA, 15 bp, Homo sapiens
ttatggtatattcat

SEQ ID NO: 104 - DNA, 15 bp, Homo sapiens
attatggtatattca

SEQ ID NO: 105 - DNA, 15 bp, Homo sapiens
aattatggtatattc

SEQ ID NO: 106 - DNA, 15 bp, Homo sapiens
aaattatggtatatt

SEQ ID NO: 107 - DNA, 15 bp, Homo sapiens
taaattatggtatat

SEQ ID NO: 108 - DNA, 15 bp, Homo sapiens
ctaaattatggtata

SEQ ID NO: 109 - DNA, 15 bp, Homo sapiens
actaaattatggtat

SEQ ID NO: 110 - DNA, 15 bp, Homo sapiens
aactaaattatggta

SEQ ID NO: 111 - DNA, 15 bp, Homo sapiens
taactaaattatggt

SEQ ID NO: 112 - DNA, 15 bp, Homo sapiens
gtaactaaattatgg

SEQ ID NO: 113 - DNA, 15 bp, Homo sapiens
agtaactaaattatg

SEQ ID NO: 114 - DNA, 15 bp, Homo sapiens
gagtaactaaattat

SEQ ID NO: 115 - DNA, 15 bp, Homo sapiens
agagtaactaaatta

SEQ ID NO: 116 - DNA, 15 bp, Homo sapiens
tagagtaactaaatt

SEQ ID NO: 117 - DNA, 15 bp, Homo sapiens
gtagagtaactaaat

SEQ ID NO: 118 - DNA, 15 bp, Homo sapiens
tgtagagtaactaaa

SEQ ID NO: 119 - DNA, 15 bp, Homo sapiens
atgtagagtaactaa

SEQ ID NO: 120 - DNA, 15 bp, Homo sapiens
aatgtagagtaacta

SEQ ID NO: 121 - DNA, 15 bp, Homo sapiens
aaatgtagagtaact

SEQ ID NO: 122 - DNA, 15 bp, Homo sapiens
gaaatgtagagtaac

SEQ ID NO: 123 - DNA, 15 bp, Homo sapiens
tgaaatgtagagtaa

SEQ ID NO: 124 - DNA, 15 bp, Homo sapiens
atgaaatgtagagta

SEQ ID NO: 125 - DNA, 15 bp, Homo sapiens
catgaaatgtagagt

SEQ ID NO: 126 - DNA, 15 bp, Homo sapiens
ccatgaaatgtagag

SEQ ID NO: 127 - DNA, 15 bp, Homo sapiens
tccatgaaatgtaga

SEQ ID NO: 128 - DNA, 15 bp, Homo sapiens
gtccatgaaatgtag

SEQ ID NO: 129 - DNA, 15 bp, Homo sapiens
ggtccatgaaatgta

SEQ ID NO: 130 - DNA, 15 bp, Homo sapiens
aggtccatgaaatgt

SEQ ID NO: 131 - DNA, 15 bp, Homo sapiens
aaggtccatgaaatg

SEQ ID NO: 132 - DNA, 15 bp, Homo sapiens
aaaggtccatgaaat

SEQ ID NO: 133 - DNA, 15 bp, Homo sapiens
caaaggtccatgaaa

SEQ ID NO: 134 - DNA, 15 bp, Homo sapiens
tcaaaggtccatgaa

SEQ ID NO: 135 - DNA, 15 bp, Homo sapiens
ttcaaaggtccatga

SEQ ID NO: 136 - DNA, 15 bp, Homo sapiens
attcaaaggtccatg

SEQ ID NO: 137 - DNA, 15 bp, Homo sapiens
aattcaaaggtccat

SEQ ID NO: 138 - DNA, 15 bp, Homo sapiens
caattcaaaggtcca

SEQ ID NO: 139 - DNA, 15 bp, Homo sapiens
gcaattcaaaggtcc

SEQ ID NO: 140 - DNA, 15 bp, Homo sapiens
agcaattcaaaggtc

SEQ ID NO: 141 - DNA, 15 bp, Homo sapiens
gagcaattcaaaggt

SEQ ID NO: 142 - DNA, 15 bp, Homo sapiens
ggagcaattcaaagg

SEQ ID NO: 143 - DNA, 15 bp, Homo sapiens
gggagcaattcaaag

SEQ ID NO: 144 - DNA, 15 bp, Homo sapiens
tgggagcaattcaaa

SEQ ID NO: 145 - DNA, 15 bp, Homo sapiens
gtgggagcaattcaa

SEQ ID NO: 146 - DNA, 15 bp, Homo sapiens
agtgggagcaattca

SEQ ID NO: 147 - DNA, 15 bp, Homo sapiens
aagtgggagcaattc

SEQ ID NO: 148 - DNA, 15 bp, Homo sapiens
aaagtgggagcaatt

SEQ ID NO: 149 - DNA, 15 bp, Homo sapiens
caaagtgggagcaat

SEQ ID NO: 150 - DNA, 15 bp, Homo sapiens
ccaaagtgggagcaa

SEQ ID NO: 151 - DNA, 15 bp, Homo sapiens
cccaaagtgggagca

SEQ ID NO: 152 - DNA, 15 bp, Homo sapiens
ccccaaagtgggagc

SEQ ID NO: 153 - DNA, 15 bp, Homo sapiens
gccccaaagtgggag

SEQ ID NO: 154 - DNA, 15 bp, Homo sapiens
agccccaaagtggga

SEQ ID NO: 155 - DNA, 15 bp, Homo sapiens
cagccccaaagtggg

SEQ ID NO: 156 - DNA, 15 bp, Homo sapiens
acagccccaaagtgg

SEQ ID NO: 157 - DNA, 15 bp, Homo sapiens
aacagccccaaagtg

SEQ ID NO: 158 - DNA, 15 bp, Homo sapiens
taacagccccaaagt

SEQ ID NO: 159 - DNA, 15 bp, Homo sapiens
ataacagccccaaag

SEQ ID NO: 160 - DNA, 15 bp, Homo sapiens
cataacagccccaaa

SEQ ID NO: 161 - DNA, 15 bp, Homo sapiens
tcataacagccccaa

SEQ ID NO: 162 - DNA, 15 bp, Homo sapiens
ttcataacagcccca

SEQ ID NO: 163 - DNA, 15 bp, Homo sapiens
attcataacagcccc

SEQ ID NO: 164 - DNA, 15 bp, Homo sapiens
tattcataacagccc

SEQ ID NO: 165 - DNA, 15 bp, Homo sapiens
ttattcataacagcc

SEQ ID NO: 166 - DNA, 15 bp, Homo sapiens
attattcataacagc

SEQ ID NO: 167 - DNA, 15 bp, Homo sapiens
cattattcataacag

SEQ ID NO: 168 - DNA, 15 bp, Homo sapiens
gcattattcataaca

SEQ ID NO: 169 - DNA, 15 bp, Homo sapiens
agcattattcataac

SEQ ID NO: 170 - DNA, 15 bp, Homo sapiens
tagcattattcataa

SEQ ID NO: 171 - DNA, 15 bp, Homo sapiens
gtagcattattcata

SEQ ID NO: 172 - DNA, 15 bp, Homo sapiens
ggtagcattattcat

SEQ ID NO: 173 - DNA, 15 bp, Homo sapiens
cggtagcattattca

SEQ ID NO: 174 - DNA, 15 bp, Homo sapiens
acggtagcattattc

SEQ ID NO: 175 - DNA, 15 bp, Homo sapiens
tacggtagcattatt

SEQ ID NO: 176 - DNA, 15 bp, Homo sapiens
ttacggtagcattat

SEQ ID NO: 177 - DNA, 15 bp, Homo sapiens
gttacggtagcatta

SEQ ID NO: 178 - DNA, 15 bp, Homo sapiens
tgttacggtagcatt

SEQ ID NO: 179 - DNA, 15 bp, Homo sapiens
atgttacggtagcat

SEQ ID NO: 180 - DNA, 15 bp, Homo sapiens
aatgttacggtagca

SEQ ID NO: 181 - DNA, 15 bp, Homo sapiens
aaatgttacggtagc

SEQ ID NO: 182 - DNA, 15 bp, Homo sapiens
aaaatgttacggtag

SEQ ID NO: 183 - DNA, 15 bp, Homo sapiens
aaaaatgttacggta

SEQ ID NO: 184 - DNA, 15 bp, Homo sapiens
caaaaatgttacggt

SEQ ID NO: 185 - DNA, 15 bp, Homo sapiens
acaaaaatgttacgg

SEQ ID NO: 186 - DNA, 15 bp, Homo sapiens
tacaaaaatgttacg

SEQ ID NO: 187 - DNA, 15 bp, Homo sapiens
atacaaaaatgttac

SEQ ID NO: 188 - DNA, 15 bp, Homo sapiens
tatacaaaaatgtta

SEQ ID NO: 189 - DNA, 15 bp, Homo sapiens
atatacaaaaatgtt

SEQ ID NO: 190 - DNA, 15 bp, Homo sapiens
gatatacaaaaatgt

SEQ ID NO: 191 - DNA, 15 bp, Homo sapiens
agatatacaaaaatg

SEQ ID NO: 192 - DNA, 15 bp, Homo sapiens
aagatatacaaaaat

SEQ ID NO: 193 - DNA, 15 bp, Homo sapiens
taagatatacaaaaa

SEQ ID NO: 194 - DNA, 15 bp, Homo sapiens
ataagatatacaaaa

SEQ ID NO: 195 - DNA, 15 bp, Homo sapiens
cataagatatacaaa

SEQ ID NO: 196 - DNA, 15 bp, Homo sapiens
tcataagatatacaa

SEQ ID NO: 197 - DNA, 15 bp, Homo sapiens
atcataagatataca

SEQ ID NO: 198 - DNA, 15 bp, Homo sapiens
catcataagatatac

SEQ ID NO: 199 - DNA, 15 bp, Homo sapiens
ccatcataagatata

SEQ ID NO: 200 - DNA, 15 bp, Homo sapiens
accatcataagatat

SEQ ID NO: 201 - DNA, 15 bp, Homo sapiens
gaccatcataagata

SEQ ID NO: 202 - DNA, 15 bp, Homo sapiens
agaccatcataagat

SEQ ID NO: 203 - DNA, 15 bp, Homo sapiens
aagaccatcataaga

SEQ ID NO: 204 - DNA, 15 bp, Homo sapiens
taagaccatcataag

SEQ ID NO: 205 - DNA, 15 bp, Homo sapiens
ttaagaccatcataa

SEQ ID NO: 206 - DNA, 15 bp, Homo sapiens
tttaagaccatcata

SEQ ID NO: 207 - DNA, 15 bp, Homo sapiens
gtttaagaccatcat

SEQ ID NO: 208 - DNA, 15 bp, Homo sapiens
tgtttaagaccatca

SEQ ID NO: 209 - DNA, 15 bp, Homo sapiens
gtgtttaagaccatc

SEQ ID NO: 210 - DNA, 15 bp, Homo sapiens
cgtgtttaagaccat

SEQ ID NO: 211 - DNA, 15 bp, Homo sapiens
gcgtgtttaagacca

SEQ ID NO: 212 - DNA, 15 bp, Homo sapiens
agcgtgtttaagacc

SEQ ID NO: 213 - DNA, 15 bp, Homo sapiens
tagcgtgtttaagac

SEQ ID NO: 214 - DNA, 15 bp, Homo sapiens
atagcgtgtttaaga

SEQ ID NO: 215 - DNA, 15 bp, Homo sapiens
gatagcgtgtttaag

SEQ ID NO: 216 - DNA, 15 bp, Homo sapiens
agatagcgtgtttaa

SEQ ID NO: 217 - DNA, 15 bp, Homo sapiens
tagatagcgtgttta

SEQ ID NO: 218 - DNA, 15 bp, Homo sapiens
gtagatagcgtgttt

SEQ ID NO: 219 - DNA, 15 bp, Homo sapiens
agtagatagcgtgtt

SEQ ID NO: 220 - DNA, 15 bp, Homo sapiens
cagtagatagcgtgt

SEQ ID NO: 221 - DNA, 15 bp, Homo sapiens
tcagtagatagcgtg

SEQ ID NO: 222 - DNA, 15 bp, Homo sapiens
ctcagtagatagcgt

SEQ ID NO: 223 - DNA, 15 bp, Homo sapiens
actcagtagatagcg

SEQ ID NO: 224 - DNA, 15 bp, Homo sapiens
tactcagtagatagc

SEQ ID NO: 225 - DNA, 15 bp, Homo sapiens
atactcagtagatag

SEQ ID NO: 226 - DNA, 15 bp, Homo sapiens
tatactcagtagata

SEQ ID NO: 227 - DNA, 15 bp, Homo sapiens
atatactcagtagat

SEQ ID NO: 228 - DNA, 15 bp, Homo sapiens
catatactcagtaga

SEQ ID NO: 229 - DNA, 15 bp, Homo sapiens
gcatatactcagtag

SEQ ID NO: 230 - DNA, 15 bp, Homo sapiens
ggcatatactcagta

SEQ ID NO: 231 - DNA, 15 bp, Homo sapiens
tggcatatactcagt

SEQ ID NO: 232 - DNA, 15 bp, Homo sapiens
ctggcatatactcag

SEQ ID NO: 233 - DNA, 15 bp, Homo sapiens
cctggcatatactca

SEQ ID NO: 234 - DNA, 15 bp, Homo sapiens
tcctggcatatactc

SEQ ID NO: 235 - DNA, 15 bp, Homo sapiens
ttcctggcatatact

SEQ ID NO: 236 - DNA, 15 bp, Homo sapiens
attcctggcatatac

SEQ ID NO: 237 - DNA, 15 bp, Homo sapiens
cattcctggcatata

SEQ ID NO: 238 - DNA, 15 bp, Homo sapiens
ccattcctggcatat

SEQ ID NO: 239 - DNA, 15 bp, Homo sapiens
tccattcctggcata

SEQ ID NO: 240 - DNA, 15 bp, Homo sapiens
ttccattcctggcat

SEQ ID NO: 241 - DNA, 15 bp, Homo sapiens
attccattcctggca

SEQ ID NO: 242 - DNA, 15 bp, Homo sapiens
aattccattcctggc

SEQ ID NO: 243 - DNA, 15 bp, Homo sapiens
caattccattcctgg

SEQ ID NO: 244 - DNA, 15 bp, Homo sapiens
gcaattccattcctg

SEQ ID NO: 245 - DNA, 15 bp, Homo sapiens
agcaattccattcct

SEQ ID NO: 246 - DNA, 15 bp, Homo sapiens
cagcaattccattcc

SEQ ID NO: 247 - DNA, 15 bp, Homo sapiens
ccagcaattccattc

SEQ ID NO: 248 - DNA, 15 bp, Homo sapiens
cccagcaattccatt

SEQ ID NO: 249 - DNA, 15 bp, Homo sapiens
acccagcaattccat

SEQ ID NO: 250 - DNA, 15 bp, Homo sapiens
gacccagcaattcca

SEQ ID NO: 251 - DNA, 15 bp, Homo sapiens
tgacccagcaattcc

SEQ ID NO: 252 - DNA, 15 bp, Homo sapiens
atgacccagcaattc

SEQ ID NO: 253 - DNA, 15 bp, Homo sapiens
tatgacccagcaatt

SEQ ID NO: 254 - DNA, 15 bp, Homo sapiens
ctatgacccagcaat

SEQ ID NO: 255 - DNA, 15 bp, Homo sapiens
cctatgacccagcaa

SEQ ID NO: 256 - DNA, 15 bp, Homo sapiens
ccctatgacccagca

SEQ ID NO: 257 - DNA, 15 bp, Homo sapiens
accctatgacccagc

SEQ ID NO: 258 - DNA, 15 bp, Homo sapiens
caccctatgacccag

SEQ ID NO: 259 - DNA, 15 bp, Homo sapiens
acaccctatgaccca

SEQ ID NO: 260 - DNA, 15 bp, Homo sapiens
cacaccctatgaccc

SEQ ID NO: 261 - DNA, 15 bp, Homo sapiens
acacaccctatgacc

SEQ ID NO: 262 - DNA, 15 bp, Homo sapiens
cacacaccctatgac

SEQ ID NO: 263 - DNA, 15 bp, Homo sapiens
acacacaccctatga

SEQ ID NO: 264 - DNA, 15 bp, Homo sapiens
gacacacaccctatg

SEQ ID NO: 265 - DNA, 15 bp, Homo sapiens
agacacacaccctat

SEQ ID NO: 266 - DNA, 15 bp, Homo sapiens
tagacacacacccta

SEQ ID NO: 267 - DNA, 15 bp, Homo sapiens
atagacacacaccct

SEQ ID NO: 268 - DNA, 15 bp, Homo sapiens
tatagacacacaccc

SEQ ID NO: 269 - DNA, 15 bp, Homo sapiens
gtatagacacacacc

SEQ ID NO: 270 - DNA, 15 bp, Homo sapiens
tgtatagacacacac

SEQ ID NO: 271 - DNA, 15 bp, Homo sapiens
gtgtatagacacaca

SEQ ID NO: 272 - DNA, 15 bp, Homo sapiens
tgtgtatagacacac

SEQ ID NO: 273 - DNA, 15 bp, Homo sapiens
gtgtgtatagacaca

SEQ ID NO: 274 - DNA, 15 bp, Homo sapiens
tgtgtgtatagacac

SEQ ID NO: 275 - DNA, 15 bp, Homo sapiens
gtgtgtgtatagaca

SEQ ID NO: 276 - DNA, 15 bp, Homo sapiens
tgtgtgtgtatagac

SEQ ID NO: 277 - DNA, 15 bp, Homo sapiens
atgtgtgtgtataga

SEQ ID NO: 278 - DNA, 15 bp, Homo sapiens
tatgtgtgtgtatag

SEQ ID NO: 279 - DNA, 15 bp, Homo sapiens
gtatgtgtgtgtata

SEQ ID NO: 280 - DNA, 15 bp, Homo sapiens
tgtatgtgtgtgtat

SEQ ID NO: 281 - DNA, 15 bp, Homo sapiens
gtgtatgtgtgtgta

SEQ ID NO: 282 - DNA, 15 bp, Homo sapiens
tgtgtatgtgtgtgt

SEQ ID NO: 283 - DNA, 15 bp, Homo sapiens
gtgtgtatgtgtgtg

SEQ ID NO: 284 - DNA, 15 bp, Homo sapiens
tgtgtgtatgtgtgt

SEQ ID NO: 285 - DNA, 15 bp, Homo sapiens
atgtgtgtatgtgtg

SEQ ID NO: 286 - DNA, 15 bp, Homo sapiens
aatgtgtgtatgtgt

SEQ ID NO: 287 - DNA, 15 bp, Homo sapiens
aaatgtgtgtatgtg

SEQ ID NO: 288 - DNA, 15 bp, Homo sapiens
aaaatgtgtgtatgt

SEQ ID NO: 289 - DNA, 15 bp, Homo sapiens
aaaaatgtgtgtatg

SEQ ID NO: 290 - DNA, 15 bp, Homo sapiens
aaaaaatgtgtgtat

SEQ ID NO: 291 - DNA, 15 bp, Homo sapiens
taaaaaatgtgtgta

SEQ ID NO: 292 - DNA, 15 bp, Homo sapiens
ctaaaaaatgtgtgt

SEQ ID NO: 293 - DNA, 15 bp, Homo sapiens
actaaaaaatgtgtg

SEQ ID NO: 294 - DNA, 15 bp, Homo sapiens
tactaaaaaatgtgt

SEQ ID NO: 295 - DNA, 15 bp, Homo sapiens
ctactaaaaaatgtg

SEQ ID NO: 296 - DNA, 15 bp, Homo sapiens
cctactaaaaaatgt

SEQ ID NO: 297 - DNA, 15 bp, Homo sapiens
acctactaaaaaatg

SEQ ID NO: 298 - DNA, 15 bp, Homo sapiens
tacctactaaaaaat

SEQ ID NO: 299 - DNA, 15 bp, Homo sapiens
gtacctactaaaaaa

SEQ ID NO: 300 - DNA, 15 bp, Homo sapiens
ggtacctactaaaaa

SEQ ID NO: 301 - DNA, 15 bp, Homo sapiens
tggtacctactaaaa

SEQ ID NO: 302 - DNA, 15 bp, Homo sapiens
atggtacctactaaa

SEQ ID NO: 303 - DNA, 15 bp, Homo sapiens
gatggtacctactaa

SEQ ID NO: 304 - DNA, 15 bp, Homo sapiens
tgatggtacctacta

SEQ ID NO: 305 - DNA, 15 bp, Homo sapiens
ttgatggtacctact

SEQ ID NO: 306 - DNA, 15 bp, Homo sapiens
tttgatggtacctac

SEQ ID NO: 307 - DNA, 15 bp, Homo sapiens
gtttgatggtaccta

SEQ ID NO: 308 - DNA, 15 bp, Homo sapiens
tgtttgatggtacct

SEQ ID NO: 309 - DNA, 15 bp, Homo sapiens
ttgtttgatggtacc

SEQ ID NO: 310 - DNA, 15 bp, Homo sapiens
attgtttgatggtac

SEQ ID NO: 311 - DNA, 15 bp, Homo sapiens
aattgtttgatggta

SEQ ID NO: 312 - DNA, 15 bp, Homo sapiens
caattgtttgatggt

SEQ ID NO: 313 - DNA, 15 bp, Homo sapiens
gcaattgtttgatgg

SEQ ID NO: 314 - DNA, 15 bp, Homo sapiens
tgcaattgtttgatg

SEQ ID NO: 315 - DNA, 15 bp, Homo sapiens
atgcaattgtttgat

SEQ ID NO: 316 - DNA, 15 bp, Homo sapiens
aatgcaattgtttga

SEQ ID NO: 317 - DNA, 15 bp, Homo sapiens
aaatgcaattgtttg

SEQ ID NO: 318 - DNA, 15 bp, Homo sapiens
aaaatgcaattgttt

SEQ ID NO: 319 - DNA, 15 bp, Homo sapiens
aaaaatgcaattgtt

SEQ ID NO: 320 - DNA, 15 bp, Homo sapiens
caaaaatgcaattgt

SEQ ID NO: 321 - DNA, 15 bp, Homo sapiens
acaaaaatgcaattg

SEQ ID NO: 322 - DNA, 15 bp, Homo sapiens
aacaaaaatgcaatt

SEQ ID NO: 323 - DNA, 15 bp, Homo sapiens
caacaaaaatgcaat

SEQ ID NO: 324 - DNA, 15 bp, Homo sapiens
acaacaaaaatgcaa

SEQ ID NO: 325 - DNA, 15 bp, Homo sapiens
aacaacaaaaatgca

SEQ ID NO: 326 - DNA, 15 bp, Homo sapiens
aaacaacaaaaatgc

SEQ ID NO: 327 - DNA, 15 bp, Homo sapiens
aaaacaacaaaaatg

SEQ ID NO: 328 - DNA, 15 bp, Homo sapiens
aaaaacaacaaaaat

SEQ ID NO: 329 - DNA, 15 bp, Homo sapiens
caaaaacaacaaaaa

SEQ ID NO: 330 - DNA, 15 bp, Homo sapiens
acaaaaacaacaaaa

SEQ ID NO: 331 - DNA, 15 bp, Homo sapiens
aacaaaaacaacaaa

SEQ ID NO: 332 - DNA, 15 bp, Homo sapiens
aaacaaaaacaacaa

SEQ ID NO: 333 - DNA, 15 bp, Homo sapiens
aaaacaaaaacaaca

SEQ ID NO: 334 - DNA, 15 bp, Homo sapiens
taaaacaaaaacaac

SEQ ID NO: 335 - DNA, 15 bp, Homo sapiens
ctaaaacaaaaacaa

SEQ ID NO: 336 - DNA, 15 bp, Homo sapiens
actaaaacaaaaaca

SEQ ID NO: 337 - DNA, 15 bp, Homo sapiens
aactaaaacaaaaac

SEQ ID NO: 338 - DNA, 15 bp, Homo sapiens
aaactaaaacaaaaa

SEQ ID NO: 339 - DNA, 15 bp, Homo sapiens
caaactaaaacaaaa

SEQ ID NO: 340 - DNA, 15 bp, Homo sapiens
acaaactaaaacaaa

SEQ ID NO: 341 - DNA, 15 bp, Homo sapiens
aacaaactaaaacaa

SEQ ID NO: 342 - DNA, 15 bp, Homo sapiens
aaacaaactaaaaca

SEQ ID NO: 343 - DNA, 15 bp, Homo sapiens
aaaacaaactaaaac

SEQ ID NO: 344 - DNA, 15 bp, Homo sapiens
aaaaacaaactaaaa

SEQ ID NO: 345 - DNA, 15 bp, Homo sapiens
taaaaacaaactaaa

SEQ ID NO: 346 - DNA, 15 bp, Homo sapiens
ttaaaaacaaactaa

SEQ ID NO: 347 - DNA, 15 bp, Homo sapiens
attaaaaacaaacta

SEQ ID NO: 348 - DNA, 15 bp, Homo sapiens
cattaaaaacaaact

SEQ ID NO: 349 - DNA, 15 bp, Homo sapiens
tcattaaaaacaaac

SEQ ID NO: 350 - DNA, 15 bp, Homo sapiens
gtcattaaaaacaaa

SEQ ID NO: 351 - DNA, 15 bp, Homo sapiens
ggtcattaaaaacaa

SEQ ID NO: 352 - DNA, 15 bp, Homo sapiens
tggtcattaaaaaca

SEQ ID NO: 353 - DNA, 15 bp, Homo sapiens
atggtcattaaaaac

SEQ ID NO: 354 - DNA, 15 bp, Homo sapiens
tatggtcattaaaaa

SEQ ID NO: 355 - DNA, 15 bp, Homo sapiens
gtatggtcattaaaa

SEQ ID NO: 356 - DNA, 15 bp, Homo sapiens
ggtatggtcattaaa

SEQ ID NO: 357 - DNA, 15 bp, Homo sapiens
tggtatggtcattaa

SEQ ID NO: 358 - DNA, 15 bp, Homo sapiens
atggtatggtcatta

SEQ ID NO: 359 - DNA, 15 bp, Homo sapiens
aatggtatggtcatt

SEQ ID NO: 360 - DNA, 15 bp, Homo sapiens
aaatggtatggtcat

SEQ ID NO: 361 - DNA, 15 bp, Homo sapiens
aaaatggtatggtca

SEQ ID NO: 362 - DNA, 15 bp, Homo sapiens
taaaatggtatggtc

SEQ ID NO: 363 - DNA, 15 bp, Homo sapiens
gtaaaatggtatggt

SEQ ID NO: 364 - DNA, 15 bp, Homo sapiens
ggtaaaatggtatgg

SEQ ID NO: 365 - DNA, 15 bp, Homo sapiens
tggtaaaatggtatg

SEQ ID NO: 366 - DNA, 15 bp, Homo sapiens
gtggtaaaatggtat

SEQ ID NO: 367 - DNA, 15 bp, Homo sapiens
ggtggtaaaatggta

SEQ ID NO: 368 - DNA, 15 bp, Homo sapiens
tggtggtaaaatggt

SEQ ID NO: 369 - DNA, 15 bp, Homo sapiens
ctggtggtaaaatgg

SEQ ID NO: 370 - DNA, 15 bp, Homo sapiens
gctggtggtaaaatg

SEQ ID NO: 371 - DNA, 15 bp, Homo sapiens
tgctggtggtaaaat

SEQ ID NO: 372 - DNA, 15 bp, Homo sapiens
ttgctggtggtaaaa

SEQ ID NO: 373 - DNA, 15 bp, Homo sapiens
attgctggtggtaaa

SEQ ID NO: 374 - DNA, 15 bp, Homo sapiens
tattgctggtggtaa

SEQ ID NO: 375 - DNA, 15 bp, Homo sapiens
ttattgctggtggta

SEQ ID NO: 376 - DNA, 15 bp, Homo sapiens
tttattgctggtggt

SEQ ID NO: 377 - DNA, 15 bp, Homo sapiens
ctttattgctggtgg

SEQ ID NO: 378 - DNA, 15 bp, Homo sapiens
cctttattgctggtg

SEQ ID NO: 379 - DNA, 15 bp, Homo sapiens
tcctttattgctggt

SEQ ID NO: 380 - DNA, 15 bp, Homo sapiens
ttcctttattgctgg

SEQ ID NO: 381 - DNA, 15 bp, Homo sapiens
cttcctttattgctg

SEQ ID NO: 382 - DNA, 15 bp, Homo sapiens
ccttcctttattgct

SEQ ID NO: 383 - DNA, 15 bp, Homo sapiens
accttcctttattgc

SEQ ID NO: 384 - DNA, 15 bp, Homo sapiens
aaccttcctttattg

SEQ ID NO: 385 - DNA, 15 bp, Homo sapiens
gaaccttcctttatt

SEQ ID NO: 386 - DNA, 15 bp, Homo sapiens
ggaaccttcctttat

SEQ ID NO: 387 - DNA, 15 bp, Homo sapiens
tggaaccttccttta

SEQ ID NO: 388 - DNA, 15 bp, Homo sapiens
atggaaccttccttt

SEQ ID NO: 389 - DNA, 15 bp, Homo sapiens
aatggaaccttcctt

SEQ ID NO: 390 - DNA, 15 bp, Homo sapiens
caatggaaccttcct

SEQ ID NO: 391 - DNA, 15 bp, Homo sapiens
gcaatggaaccttcc

SEQ ID NO: 392 - DNA, 15 bp, Homo sapiens
agcaatggaaccttc

SEQ ID NO: 393 - DNA, 15 bp, Homo sapiens
gagcaatggaacctt

SEQ ID NO: 394 - DNA, 15 bp, Homo sapiens
ggagcaatggaacct

SEQ ID NO: 395 - DNA, 15 bp, Homo sapiens
tggagcaatggaacc

SEQ ID NO: 396 - DNA, 15 bp, Homo sapiens
atggagcaatggaac

SEQ ID NO: 397 - DNA, 15 bp, Homo sapiens
tatggagcaatggaa

SEQ ID NO: 398 - DNA, 15 bp, Homo sapiens
gtatggagcaatgga

SEQ ID NO: 399 - DNA, 15 bp, Homo sapiens
ggtatggagcaatgg

SEQ ID NO: 400 - DNA, 15 bp, Homo sapiens
tggtatggagcaatg

SEQ ID NO: 401 - DNA, 15 bp, Homo sapiens
ctggtatggagcaat

SEQ ID NO: 402 - DNA, 15 bp, Homo sapiens
gctggtatggagcaa

SEQ ID NO: 403 - DNA, 15 bp, Homo sapiens
tgctggtatggagca

SEQ ID NO: 404 - DNA, 15 bp, Homo sapiens
atgctggtatggagc

SEQ ID NO: 405 - DNA, 15 bp, Homo sapiens
aatgctggtatggag

SEQ ID NO: 406 - DNA, 15 bp, Homo sapiens
taatgctggtatgga

SEQ ID NO: 407 - DNA, 15 bp, Homo sapiens
ctaatgctggtatgg

SEQ ID NO: 408 - DNA, 15 bp, Homo sapiens
cctaatgctggtatg

SEQ ID NO: 409 - DNA, 15 bp, Homo sapiens
acctaatgctggtat

SEQ ID NO: 410 - DNA, 15 bp, Homo sapiens
tacctaatgctggta

SEQ ID NO: 411 - DNA, 15 bp, Homo sapiens
atacctaatgctggt

SEQ ID NO: 412 - DNA, 15 bp, Homo sapiens
aatacctaatgctgg

SEQ ID NO: 413 - DNA, 15 bp, Homo sapiens
taatacctaatgctg

SEQ ID NO: 414 - DNA, 15 bp, Homo sapiens
ataatacctaatgct

SEQ ID NO: 415 - DNA, 15 bp, Homo sapiens
gataatacctaatgc

SEQ ID NO: 416 - DNA, 15 bp, Homo sapiens
tgataatacctaatg

SEQ ID NO: 417 - DNA, 15 bp, Homo sapiens
ctgataatacctaat

SEQ ID NO: 418 - DNA, 15 bp, Homo sapiens
actgataatacctaa

SEQ ID NO: 419 - DNA, 15 bp, Homo sapiens
gactgataataccta

SEQ ID NO: 420 - DNA, 15 bp, Homo sapiens
ggactgataatacct

SEQ ID NO: 421 - DNA, 15 bp, Homo sapiens
aggactgataatacc

SEQ ID NO: 422 - DNA, 15 bp, Homo sapiens
aaggactgataatac

SEQ ID NO: 423 - DNA, 15 bp, Homo sapiens
aaaggactgataata

SEQ ID NO: 424 - DNA, 15 bp, Homo sapiens
aaaaggactgataat

SEQ ID NO: 425 - DNA, 15 bp, Homo sapiens
taaaaggactgataa

SEQ ID NO: 426 - DNA, 15 bp, Homo sapiens
ataaaaggactgata

SEQ ID NO: 427 - DNA, 15 bp, Homo sapiens
gataaaaggactgat

SEQ ID NO: 428 - DNA, 15 bp, Homo sapiens
agataaaaggactga

SEQ ID NO: 429 - DNA, 15 bp, Homo sapiens
aagataaaaggactg

SEQ ID NO: 430 - DNA, 15 bp, Homo sapiens
aaagataaaaggact

SEQ ID NO: 431 - DNA, 15 bp, Homo sapiens
taaagataaaaggac

SEQ ID NO: 432 - DNA, 15 bp, Homo sapiens
ttaaagataaaagga

SEQ ID NO: 433 - DNA, 15 bp, Homo sapiens
gttaaagataaaagg

SEQ ID NO: 434 - DNA, 15 bp, Homo sapiens
ggttaaagataaaag

SEQ ID NO: 435 - DNA, 15 bp, Homo sapiens
tggttaaagataaaa

SEQ ID NO: 436 - DNA, 15 bp, Homo sapiens
atggttaaagataaa

SEQ ID NO: 437 - DNA, 15 bp, Homo sapiens
tatggttaaagataa

SEQ ID NO: 438 - DNA, 15 bp, Homo sapiens
atatggttaaagata

SEQ ID NO: 439 - DNA, 15 bp, Homo sapiens
aatatggttaaagat

SEQ ID NO: 440 - DNA, 15 bp, Homo sapiens
caatatggttaaaga

SEQ ID NO: 441 - DNA, 15 bp, Homo sapiens
ccaatatggttaaag

SEQ ID NO: 442 - DNA, 15 bp, Homo sapiens
accaatatggttaaa

SEQ ID NO: 443 - DNA, 15 bp, Homo sapiens
caccaatatggttaa

SEQ ID NO: 444 - DNA, 15 bp, Homo sapiens
ccaccaatatggtta

SEQ ID NO: 445 - DNA, 15 bp, Homo sapiens
cccaccaatatggtt

SEQ ID NO: 446 - DNA, 15 bp, Homo sapiens
tcccaccaatatggt

SEQ ID NO: 447 - DNA, 15 bp, Homo sapiens
ctcccaccaatatgg

SEQ ID NO: 448 - DNA, 15 bp, Homo sapiens
cctcccaccaatatg

SEQ ID NO: 449 - DNA, 15 bp, Homo sapiens
acctcccaccaatat

SEQ ID NO: 450 - DNA, 15 bp, Homo sapiens
tacctcccaccaata

SEQ ID NO: 451 - DNA, 15 bp, Homo sapiens
ctacctcccaccaat

SEQ ID NO: 452 - DNA, 15 bp, Homo sapiens
actacctcccaccaa

SEQ ID NO: 453 - DNA, 15 bp, Homo sapiens
cactacctcccacca

SEQ ID NO: 454 - DNA, 15 bp, Homo sapiens
ccactacctcccacc

SEQ ID NO: 455 - DNA, 15 bp, Homo sapiens
accactacctcccac

SEQ ID NO: 456 - DNA, 15 bp, Homo sapiens
taccactacctccca

SEQ ID NO: 457 - DNA, 15 bp, Homo sapiens
ataccactacctccc

SEQ ID NO: 458 - DNA, 15 bp, Homo sapiens
gataccactacctcc

SEQ ID NO: 459 - DNA, 15 bp, Homo sapiens
agataccactacctc

SEQ ID NO: 460 - DNA, 15 bp, Homo sapiens
gagataccactacct

SEQ ID NO: 461 - DNA, 15 bp, Homo sapiens
tgagataccactacc

SEQ ID NO: 462 - DNA, 15 bp, Homo sapiens
atgagataccactac

SEQ ID NO: 463 - DNA, 15 bp, Homo sapiens
aatgagataccacta

SEQ ID NO: 464 - DNA, 15 bp, Homo sapiens
caatgagataccact

SEQ ID NO: 465 - DNA, 15 bp, Homo sapiens
acaatgagataccac

SEQ ID NO: 466 - DNA, 15 bp, Homo sapiens
tacaatgagatacca

SEQ ID NO: 467 - DNA, 15 bp, Homo sapiens
ctacaatgagatacc

SEQ ID NO: 468 - DNA, 15 bp, Homo sapiens
actacaatgagatac

SEQ ID NO: 469 - DNA, 15 bp, Homo sapiens
gactacaatgagata

SEQ ID NO: 470 - DNA, 15 bp, Homo sapiens
agactacaatgagat

SEQ ID NO: 471 - DNA, 15 bp, Homo sapiens
aagactacaatgaga

SEQ ID NO: 472 - DNA, 15 bp, Homo sapiens
taagactacaatgag

SEQ ID NO: 473 - DNA, 15 bp, Homo sapiens
ttaagactacaatga

SEQ ID NO: 474 - DNA, 15 bp, Homo sapiens
attaagactacaatg

SEQ ID NO: 475 - DNA, 15 bp, Homo sapiens
aattaagactacaat

SEQ ID NO: 476 - DNA, 15 bp, Homo sapiens
aaattaagactacaa

SEQ ID NO: 477 - DNA, 15 bp, Homo sapiens
taaattaagactaca

SEQ ID NO: 478 - DNA, 15 bp, Homo sapiens
gtaaattaagactac

SEQ ID NO: 479 - DNA, 15 bp, Homo sapiens
agtaaattaagacta

SEQ ID NO: 480 - DNA, 15 bp, Homo sapiens
aagtaaattaagact

SEQ ID NO: 481 - DNA, 15 bp, Homo sapiens
gaagtaaattaagac

SEQ ID NO: 482 - DNA, 15 bp, Homo sapiens
ggaagtaaattaaga

SEQ ID NO: 483 - DNA, 15 bp, Homo sapiens
tggaagtaaattaag

SEQ ID NO: 484 - DNA, 15 bp, Homo sapiens
atggaagtaaattaa

SEQ ID NO: 485 - DNA, 15 bp, Homo sapiens
tatggaagtaaatta

SEQ ID NO: 486 - DNA, 15 bp, Homo sapiens
atatggaagtaaatt

SEQ ID NO: 487 - DNA, 15 bp, Homo sapiens
tatatggaagtaaat

SEQ ID NO: 488 - DNA, 15 bp, Homo sapiens
gtatatggaagtaaa

SEQ ID NO: 489 - DNA, 15 bp, Homo sapiens
agtatatggaagtaa

SEQ ID NO: 490 - DNA, 15 bp, Homo sapiens
aagtatatggaagta

SEQ ID NO: 491 - DNA, 15 bp, Homo sapiens
taagtatatggaagt

SEQ ID NO: 492 - DNA, 15 bp, Homo sapiens
ttaagtatatggaag

SEQ ID NO: 493 - DNA, 15 bp, Homo sapiens
attaagtatatggaa

SEQ ID NO: 494 - DNA, 15 bp, Homo sapiens
aattaagtatatgga

SEQ ID NO: 495 - DNA, 15 bp, Homo sapiens
aaattaagtatatgg

SEQ ID NO: 496 - DNA, 15 bp, Homo sapiens
taaattaagtatatg

SEQ ID NO: 497 - DNA, 15 bp, Homo sapiens
ttaaattaagtatat

SEQ ID NO: 498 - DNA, 15 bp, Homo sapiens
tttaaattaagtata

SEQ ID NO: 499 - DNA, 15 bp, Homo sapiens
atttaaattaagtat

SEQ ID NO: 500 - DNA, 15 bp, Homo sapiens
tatttaaattaagta

SEQ ID NO: 501 - DNA, 15 bp, Homo sapiens
gtatttaaattaagt

SEQ ID NO: 502 - DNA, 15 bp, Homo sapiens
tgtatttaaattaag

SEQ ID NO: 503 - DNA, 15 bp, Homo sapiens
gtgtatttaaattaa

SEQ ID NO: 504 - DNA, 15 bp, Homo sapiens
agtgtatttaaatta

SEQ ID NO: 505 - DNA, 15 bp, Homo sapiens
gagtgtatttaaatt

SEQ ID NO: 506 - DNA, 15 bp, Homo sapiens
tgagtgtatttaaat

SEQ ID NO: 507 - DNA, 15 bp, Homo sapiens
ttgagtgtatttaaa

SEQ ID NO: 508 - DNA, 15 bp, Homo sapiens
attgagtgtatttaa

SEQ ID NO: 509 - DNA, 15 bp, Homo sapiens
aattgagtgtattta

SEQ ID NO: 510 - DNA, 15 bp, Homo sapiens
aaattgagtgtattt

SEQ ID NO: 511 - DNA, 15 bp, Homo sapiens
taaattgagtgtatt

SEQ ID NO: 512 - DNA, 15 bp, Homo sapiens
ataaattgagtgtat

SEQ ID NO: 513 - DNA, 15 bp, Homo sapiens
tataaattgagtgta

SEQ ID NO: 514 - DNA, 15 bp, Homo sapiens
atataaattgagtgt

SEQ ID NO: 515 - DNA, 15 bp, Homo sapiens
tatataaattgagtg

SEQ ID NO: 516 - DNA, 15 bp, Homo sapiens
gtatataaattgagt

SEQ ID NO: 517 - DNA, 15 bp, Homo sapiens
tgtatataaattgag

SEQ ID NO: 518 - DNA, 15 bp, Homo sapiens
gtgtatataaattga

SEQ ID NO: 519 - DNA, 15 bp, Homo sapiens
tgtgtatataaattg

SEQ ID NO: 520 - DNA, 15 bp, Homo sapiens
gtgtgtatataaatt

SEQ ID NO: 521 - DNA, 15 bp, Homo sapiens
tgtgtgtatataaat

SEQ ID NO: 522 - DNA, 15 bp, Homo sapiens
gtgtgtgtatataaa

SEQ ID NO: 523 - DNA, 15 bp, Homo sapiens
cgtgtgtgtatataa

SEQ ID NO: 524 - DNA, 15 bp, Homo sapiens
acgtgtgtgtatata

SEQ ID NO: 525 - DNA, 15 bp, Homo sapiens
tacgtgtgtgtatat

SEQ ID NO: 526 - DNA, 15 bp, Homo sapiens
atacgtgtgtgtata

SEQ ID NO: 527 - DNA, 15 bp, Homo sapiens
tatacgtgtgtgtat

SEQ ID NO: 528 - DNA, 15 bp, Homo sapiens
gtatacgtgtgtgta

SEQ ID NO: 529 - DNA, 15 bp, Homo sapiens
agtatacgtgtgtgt

SEQ ID NO: 530 - DNA, 15 bp, Homo sapiens
gagtatacgtgtgtg

SEQ ID NO: 531 - DNA, 15 bp, Homo sapiens
agagtatacgtgtgt

SEQ ID NO: 532 - DNA, 15 bp, Homo sapiens
gagagtatacgtgtg

SEQ ID NO: 533 - DNA, 15 bp, Homo sapiens
agagagtatacgtgt

SEQ ID NO: 534 - DNA, 15 bp, Homo sapiens
gagagagtatacgtg

SEQ ID NO: 535 - DNA, 15 bp, Homo sapiens
tgagagagtatacgt

SEQ ID NO: 536 - DNA, 15 bp, Homo sapiens
ctgagagagtatacg

SEQ ID NO: 537 - DNA, 15 bp, Homo sapiens
gctgagagagtatac

SEQ ID NO: 538 - DNA, 15 bp, Homo sapiens
ggctgagagagtata

SEQ ID NO: 539 - DNA, 15 bp, Homo sapiens
aggctgagagagtat

SEQ ID NO: 540 - DNA, 15 bp, Homo sapiens
aaggctgagagagta

SEQ ID NO: 541 - DNA, 15 bp, Homo sapiens
gaaggctgagagagt

SEQ ID NO: 542 - DNA, 15 bp, Homo sapiens
tgaaggctgagagag

SEQ ID NO: 543 - DNA, 15 bp, Homo sapiens
ctgaaggctgagaga

SEQ ID NO: 544 - DNA, 15 bp, Homo sapiens
actgaaggctgagag

SEQ ID NO: 545 - DNA, 15 bp, Homo sapiens
tactgaaggctgaga

SEQ ID NO: 546 - DNA, 15 bp, Homo sapiens
ttactgaaggctgag

SEQ ID NO: 547 - DNA, 15 bp, Homo sapiens
cttactgaaggctga

SEQ ID NO: 548 - DNA, 15 bp, Homo sapiens
gcttactgaaggctg

SEQ ID NO: 549 - DNA, 15 bp, Homo sapiens
ggcttactgaaggct

SEQ ID NO: 550 - DNA, 15 bp, Homo sapiens
tggcttactgaaggc

SEQ ID NO: 551 - DNA, 15 bp, Homo sapiens
ctggcttactgaagg

SEQ ID NO: 552 - DNA, 15 bp, Homo sapiens
actggcttactgaag

SEQ ID NO: 553 - DNA, 15 bp, Homo sapiens
gactggcttactgaa

SEQ ID NO: 554 - DNA, 15 bp, Homo sapiens
agactggcttactga

SEQ ID NO: 555 - DNA, 15 bp, Homo sapiens
gagactggcttactg

SEQ ID NO: 556 - DNA, 15 bp, Homo sapiens
tgagactggcttact

SEQ ID NO: 557 - DNA, 15 bp, Homo sapiens
atgagactggcttac

SEQ ID NO: 558 - DNA, 15 bp, Homo sapiens
aatgagactggctta

SEQ ID NO: 559 - DNA, 15 bp, Homo sapiens
gaatgagactggctt

SEQ ID NO: 560 - DNA, 15 bp, Homo sapiens
ggaatgagactggct

SEQ ID NO: 561 - DNA, 15 bp, Homo sapiens
gggaatgagactggc

SEQ ID NO: 562 - DNA, 15 bp, Homo sapiens
ggggaatgagactgg

SEQ ID NO: 563 - DNA, 15 bp, Homo sapiens
aggggaatgagactg

SEQ ID NO: 564 - DNA, 15 bp, Homo sapiens
caggggaatgagact

SEQ ID NO: 565 - DNA, 15 bp, Homo sapiens
tcaggggaatgagac

SEQ ID NO: 566 - DNA, 15 bp, Homo sapiens
ttcaggggaatgaga

SEQ ID NO: 567 - DNA, 15 bp, Homo sapiens
gttcaggggaatgag

SEQ ID NO: 568 - DNA, 15 bp, Homo sapiens
agttcaggggaatga

SEQ ID NO: 569 - DNA, 15 bp, Homo sapiens
tagttcaggggaatg

SEQ ID NO: 570 - DNA, 15 bp, Homo sapiens
ttagttcaggggaat

SEQ ID NO: 571 - DNA, 15 bp, Homo sapiens
gttagttcaggggaa

SEQ ID NO: 572 - DNA, 15 bp, Homo sapiens
ggttagttcagggga

SEQ ID NO: 573 - DNA, 15 bp, Homo sapiens
tggttagttcagggg

SEQ ID NO: 574 - DNA, 15 bp, Homo sapiens
ttggttagttcaggg

SEQ ID NO: 575 - DNA, 15 bp, Homo sapiens
attggttagttcagg

SEQ ID NO: 576 - DNA, 15 bp, Homo sapiens
cattggttagttcag

SEQ ID NO: 577 - DNA, 15 bp, Homo sapiens
acattggttagttca

SEQ ID NO: 578 - DNA, 15 bp, Homo sapiens
aacattggttagttc

SEQ ID NO: 579 - DNA, 15 bp, Homo sapiens
taacattggttagtt

SEQ ID NO: 580 - DNA, 15 bp, Homo sapiens
ttaacattggttagt

SEQ ID NO: 581 - DNA, 15 bp, Homo sapiens
attaacattggttag

SEQ ID NO: 582 - DNA, 15 bp, Homo sapiens
tattaacattggtta

SEQ ID NO: 583 - DNA, 15 bp, Homo sapiens
ttattaacattggtt

SEQ ID NO: 584 - DNA, 15 bp, Homo sapiens
attattaacattggt

SEQ ID NO: 585 - DNA, 15 bp, Homo sapiens
cattattaacattgg

SEQ ID NO: 586 - DNA, 15 bp, Homo sapiens
ccattattaacattg

SEQ ID NO: 587 - DNA, 15 bp, Homo sapiens
accattattaacatt

SEQ ID NO: 588 - DNA, 15 bp, Homo sapiens
taccattattaacat

SEQ ID NO: 589 - DNA, 15 bp, Homo sapiens
ataccattattaaca

SEQ ID NO: 590 - DNA, 15 bp, Homo sapiens
cataccattattaac

SEQ ID NO: 591 - DNA, 15 bp, Homo sapiens
gcataccattattaa

SEQ ID NO: 592 - DNA, 15 bp, Homo sapiens
agcataccattatta

SEQ ID NO: 593 - DNA, 15 bp, Homo sapiens
aagcataccattatt

SEQ ID NO: 594 - DNA, 15 bp, Homo sapiens
gaagcataccattat

SEQ ID NO: 595 - DNA, 15 bp, Homo sapiens
agaagcataccatta

SEQ ID NO: 596 - DNA, 15 bp, Homo sapiens
gagaagcataccatt

SEQ ID NO: 597 - DNA, 15 bp, Homo sapiens
agagaagcataccat

SEQ ID NO: 598 - DNA, 15 bp, Homo sapiens
gagagaagcatacca

SEQ ID NO: 599 - DNA, 15 bp, Homo sapiens
tgagagaagcatacc

SEQ ID NO: 600 - DNA, 15 bp, Homo sapiens
ctgagagaagcatac

SEQ ID NO: 601 - DNA, 15 bp, Homo sapiens
actgagagaagcata

SEQ ID NO: 602 - DNA, 15 bp, Homo sapiens
cactgagagaagcat

SEQ ID NO: 603 - DNA, 15 bp, Homo sapiens
gcactgagagaagca

SEQ ID NO: 604 - DNA, 15 bp, Homo sapiens
agcactgagagaagc

SEQ ID NO: 605 - DNA, 15 bp, Homo sapiens
gagcactgagagaag

SEQ ID NO: 606 - DNA, 15 bp, Homo sapiens
tgagcactgagagaa

SEQ ID NO: 607 - DNA, 15 bp, Homo sapiens
atgagcactgagaga

SEQ ID NO: 608 - DNA, 15 bp, Homo sapiens
catgagcactgagag

SEQ ID NO: 609 - DNA, 15 bp, Homo sapiens
gcatgagcactgaga

SEQ ID NO: 610 - DNA, 15 bp, Homo sapiens
tgcatgagcactgag

SEQ ID NO: 611 - DNA, 15 bp, Homo sapiens
ttgcatgagcactga

SEQ ID NO: 612 - DNA, 15 bp, Homo sapiens
tttgcatgagcactg

SEQ ID NO: 613 - DNA, 15 bp, Homo sapiens
gtttgcatgagcact

SEQ ID NO: 614 - DNA, 15 bp, Homo sapiens
tgtttgcatgagcac

SEQ ID NO: 615 - DNA, 15 bp, Homo sapiens
atgtttgcatgagca

SEQ ID NO: 616 - DNA, 15 bp, Homo sapiens
catgtttgcatgagc

SEQ ID NO: 617 - DNA, 15 bp, Homo sapiens
gcatgtttgcatgag

SEQ ID NO: 618 - DNA, 15 bp, Homo sapiens
tgcatgtttgcatga

SEQ ID NO: 619 - DNA, 15 bp, Homo sapiens
atgcatgtttgcatg

SEQ ID NO: 620 - DNA, 15 bp, Homo sapiens
tatgcatgtttgcat

SEQ ID NO: 621 - DNA, 15 bp, Homo sapiens
gtatgcatgtttgca

SEQ ID NO: 622 - DNA, 15 bp, Homo sapiens
tgtatgcatgtttgc

SEQ ID NO: 623 - DNA, 15 bp, Homo sapiens
gtgtatgcatgtttg

SEQ ID NO: 624 - DNA, 15 bp, Homo sapiens
tgtgtatgcatgttt

SEQ ID NO: 625 - DNA, 15 bp, Homo sapiens
gtgtgtatgcatgtt

SEQ ID NO: 626 - DNA, 15 bp, Homo sapiens
tgtgtgtatgcatgt

SEQ ID NO: 627 - DNA, 15 bp, Homo sapiens
gtgtgtgtatgcatg

SEQ ID NO: 628 - DNA, 15 bp, Homo sapiens
tgtgtgtgtatgcat

SEQ ID NO: 629 - DNA, 15 bp, Homo sapiens
atgtgtgtgtatgca

SEQ ID NO: 630 - DNA, 15 bp, Homo sapiens
tatgtgtgtgtatgc

SEQ ID NO: 631 - DNA, 15 bp, Homo sapiens
gtatgtgtgtgtatg

SEQ ID NO: 632 - DNA, 15 bp, Homo sapiens
atgtgtatgtgtgtg

SEQ ID NO: 633 - DNA, 15 bp, Homo sapiens
tatgtgtatgtgtgt

SEQ ID NO: 634 - DNA, 15 bp, Homo sapiens
ttatgtgtatgtgtg

SEQ ID NO: 635 - DNA, 15 bp, Homo sapiens
tttatgtgtatgtgt

SEQ ID NO: 636 - DNA, 15 bp, Homo sapiens
atttatgtgtatgtg

SEQ ID NO: 637 - DNA, 15 bp, Homo sapiens
tatttatgtgtatgt

SEQ ID NO: 638 - DNA, 15 bp, Homo sapiens
ttatttatgtgtatg

SEQ ID NO: 639 - DNA, 15 bp, Homo sapiens
cttatttatgtgtat

SEQ ID NO: 640 - DNA, 15 bp, Homo sapiens
ccttatttatgtgta

SEQ ID NO: 641 - DNA, 15 bp, Homo sapiens
cccttatttatgtgt

SEQ ID NO: 642 - DNA, 15 bp, Homo sapiens
ccccttatttatgtg

SEQ ID NO: 643 - DNA, 15 bp, Homo sapiens
accccttatttatgt

SEQ ID NO: 644 - DNA, 15 bp, Homo sapiens
caccccttatttatg

SEQ ID NO: 645 - DNA, 15 bp, Homo sapiens
acaccccttatttat

SEQ ID NO: 646 - DNA, 15 bp, Homo sapiens
cacaccccttattta

SEQ ID NO: 647 - DNA, 15 bp, Homo sapiens
ccacaccccttattt

SEQ ID NO: 648 - DNA, 15 bp, Homo sapiens
cccacaccccttatt

SEQ ID NO: 649 - DNA, 15 bp, Homo sapiens
tcccacaccccttat

SEQ ID NO: 650 - DNA, 15 bp, Homo sapiens
ttcccacacccctta

SEQ ID NO: 651 - DNA, 15 bp, Homo sapiens
attcccacacccctt

SEQ ID NO: 652 - DNA, 15 bp, Homo sapiens
cattcccacacccct

SEQ ID NO: 653 - DNA, 15 bp, Homo sapiens
acattcccacacccc

SEQ ID NO: 654 - DNA, 15 bp, Homo sapiens
tacattcccacaccc

SEQ ID NO: 655 - DNA, 15 bp, Homo sapiens
atacattcccacacc

SEQ ID NO: 656 - DNA, 15 bp, Homo sapiens
aatacattcccacac

SEQ ID NO: 657 - DNA, 15 bp, Homo sapiens
aaatacattcccaca

SEQ ID NO: 658 - DNA, 15 bp, Homo sapiens
caaatacattcccac

SEQ ID NO: 659 - DNA, 15 bp, Homo sapiens
tcaaatacattccca

SEQ ID NO: 660 - DNA, 15 bp, Homo sapiens
atcaaatacattccc

SEQ ID NO: 661 - DNA, 15 bp, Homo sapiens
aatcaaatacattcc

SEQ ID NO: 662 - DNA, 15 bp, Homo sapiens
gaatcaaatacattc

SEQ ID NO: 663 - DNA, 15 bp, Homo sapiens
agaatcaaatacatt

SEQ ID NO: 664 - DNA, 15 bp, Homo sapiens
cagaatcaaatacat

SEQ ID NO: 665 - DNA, 15 bp, Homo sapiens
tcagaatcaaataca

SEQ ID NO: 666 - DNA, 15 bp, Homo sapiens
ctcagaatcaaatac

SEQ ID NO: 667 - DNA, 15 bp, Homo sapiens
tctcagaatcaaata

SEQ ID NO: 668 - DNA, 15 bp, Homo sapiens
ctctcagaatcaaat

SEQ ID NO: 669 - DNA, 15 bp, Homo sapiens
gctctcagaatcaaa

SEQ ID NO: 670 - DNA, 15 bp, Homo sapiens
agctctcagaatcaa

SEQ ID NO: 671 - DNA, 15 bp, Homo sapiens
cagctctcagaatca

SEQ ID NO: 672 - DNA, 15 bp, Homo sapiens
gcagctctcagaatc

SEQ ID NO: 673 - DNA, 15 bp, Homo sapiens
agcagctctcagaat

SEQ ID NO: 674 - DNA, 15 bp, Homo sapiens
cagcagctctcagaa

SEQ ID NO: 675 - DNA, 15 bp, Homo sapiens
acagcagctctcaga

SEQ ID NO: 676 - DNA, 15 bp, Homo sapiens
tacagcagctctcag

SEQ ID NO: 677 - DNA, 15 bp, Homo sapiens
ttacagcagctctca

SEQ ID NO: 678 - DNA, 15 bp, Homo sapiens
gttacagcagctctc

SEQ ID NO: 679 - DNA, 15 bp, Homo sapiens
tgttacagcagctct

SEQ ID NO: 680 - DNA, 15 bp, Homo sapiens
ttgttacagcagctc

SEQ ID NO: 681 - DNA, 15 bp, Homo sapiens
tttgttacagcagct

SEQ ID NO: 682 - DNA, 15 bp, Homo sapiens
atttgttacagcagc

SEQ ID NO: 683 - DNA, 15 bp, Homo sapiens
aatttgttacagcag

SEQ ID NO: 684 - DNA, 15 bp, Homo sapiens
taatttgttacagca

SEQ ID NO: 685 - DNA, 15 bp, Homo sapiens
gtaatttgttacagc

SEQ ID NO: 686 - DNA, 15 bp, Homo sapiens
ggtaatttgttacag

SEQ ID NO: 687 - DNA, 15 bp, Homo sapiens
tggtaatttgttaca

SEQ ID NO: 688 - DNA, 15 bp, Homo sapiens
gtggtaatttgttac

SEQ ID NO: 689 - DNA, 15 bp, Homo sapiens
tgtggtaatttgtta

SEQ ID NO: 690 - DNA, 15 bp, Homo sapiens
ttgtggtaatttgtt

SEQ ID NO: 691 - DNA, 15 bp, Homo sapiens
tttgtggtaatttgt

SEQ ID NO: 692 - DNA, 15 bp, Homo sapiens
gtttgtggtaatttg

SEQ ID NO: 693 - DNA, 15 bp, Homo sapiens
agtttgtggtaattt

SEQ ID NO: 694 - DNA, 15 bp, Homo sapiens
aagtttgtggtaatt

SEQ ID NO: 695 - DNA, 15 bp, Homo sapiens
taagtttgtggtaat

SEQ ID NO: 696 - DNA, 15 bp, Homo sapiens
ctaagtttgtggtaa

SEQ ID NO: 697 - DNA, 15 bp, Homo sapiens
actaagtttgtggta

SEQ ID NO: 698 - DNA, 15 bp, Homo sapiens
cactaagtttgtggt

SEQ ID NO: 699 - DNA, 15 bp, Homo sapiens
ccactaagtttgtgg

SEQ ID NO: 700 - DNA, 15 bp, Homo sapiens
gccactaagtttgtg

SEQ ID NO: 701 - DNA, 15 bp, Homo sapiens
agccactaagtttgt

SEQ ID NO: 702 - DNA, 15 bp, Homo sapiens
aagccactaagtttg

SEQ ID NO: 703 - DNA, 15 bp, Homo sapiens
taagccactaagttt

SEQ ID NO: 704 - DNA, 15 bp, Homo sapiens
ttaagccactaagtt

SEQ ID NO: 705 - DNA, 15 bp, Homo sapiens
tttaagccactaagt

SEQ ID NO: 706 - DNA, 15 bp, Homo sapiens
ttttaagccactaag

SEQ ID NO: 707 - DNA, 15 bp, Homo sapiens
gttttaagccactaa

SEQ ID NO: 708 - DNA, 15 bp, Homo sapiens
tgttttaagccacta

SEQ ID NO: 709 - DNA, 15 bp, Homo sapiens
ttgttttaagccact

SEQ ID NO: 710 - DNA, 15 bp, Homo sapiens
gttgttttaagccac

SEQ ID NO: 711 - DNA, 15 bp, Homo sapiens
tgttgttttaagcca

SEQ ID NO: 712 - DNA, 15 bp, Homo sapiens
ctgttgttttaagcc

SEQ ID NO: 713 - DNA, 15 bp, Homo sapiens
tctgttgttttaagc

SEQ ID NO: 714 - DNA, 15 bp, Homo sapiens
ttctgttgttttaag

SEQ ID NO: 715 - DNA, 15 bp, Homo sapiens
tttctgttgttttaa

SEQ ID NO: 716 - DNA, 15 bp, Homo sapiens
atttctgttgtttta

SEQ ID NO: 717 - DNA, 15 bp, Homo sapiens
tatttctgttgtttt

SEQ ID NO: 718 - DNA, 15 bp, Homo sapiens
atatttctgttgttt

SEQ ID NO: 719 - DNA, 15 bp, Homo sapiens
aatatttctgttgtt

SEQ ID NO: 720 - DNA, 15 bp, Homo sapiens
aaatatttctgttgt

SEQ ID NO: 721 - DNA, 15 bp, Homo sapiens
gaaatatttctgttg

SEQ ID NO: 722 - DNA, 15 bp, Homo sapiens
agaaatatttctgtt

SEQ ID NO: 723 - DNA, 15 bp, Homo sapiens
cagaaatatttctgt

SEQ ID NO: 724 - DNA, 15 bp, Homo sapiens
acagaaatatttctg

SEQ ID NO: 725 - DNA, 15 bp, Homo sapiens
aacagaaatatttct

SEQ ID NO: 726 - DNA, 15 bp, Homo sapiens
gaacagaaatatttc

SEQ ID NO: 727 - DNA, 15 bp, Homo sapiens
tgaacagaaatattt

SEQ ID NO: 728 - DNA, 15 bp, Homo sapiens
gtgaacagaaatatt

SEQ ID NO: 729 - DNA, 15 bp, Homo sapiens
tgtgaacagaaatat

SEQ ID NO: 730 - DNA, 15 bp, Homo sapiens
ctgtgaacagaaata

SEQ ID NO: 731 - DNA, 15 bp, Homo sapiens
actgtgaacagaaat

SEQ ID NO: 732 - DNA, 15 bp, Homo sapiens
aactgtgaacagaaa

SEQ ID NO: 733 - DNA, 15 bp, Homo sapiens
gaactgtgaacagaa

SEQ ID NO: 734 - DNA, 15 bp, Homo sapiens
agaactgtgaacaga

SEQ ID NO: 735 - DNA, 15 bp, Homo sapiens
cagaactgtgaacag

SEQ ID NO: 736 - DNA, 15 bp, Homo sapiens
ccagaactgtgaaca

SEQ ID NO: 737 - DNA, 15 bp, Homo sapiens
tccagaactgtgaac

SEQ ID NO: 738 - DNA, 15 bp, Homo sapiens
ctccagaactgtgaa

SEQ ID NO: 739 - DNA, 15 bp, Homo sapiens
cctccagaactgtga

SEQ ID NO: 740 - DNA, 15 bp, Homo sapiens
gcctccagaactgtg

SEQ ID NO: 741 - DNA, 15 bp, Homo sapiens
ggcctccagaactgt

SEQ ID NO: 742 - DNA, 15 bp, Homo sapiens
tggcctccagaactg

SEQ ID NO: 743 - DNA, 15 bp, Homo sapiens
ctggcctccagaact

SEQ ID NO: 744 - DNA, 15 bp, Homo sapiens
tctggcctccagaac

SEQ ID NO: 745 - DNA, 15 bp, Homo sapiens
ttctggcctccagaa

SEQ ID NO: 746 - DNA, 15 bp, Homo sapiens
tttctggcctccaga

SEQ ID NO: 747 - DNA, 15 bp, Homo sapiens
atttctggcctccag

SEQ ID NO: 748 - DNA, 15 bp, Homo sapiens
gatttctggcctcca

SEQ ID NO: 749 - DNA, 15 bp, Homo sapiens
agatttctggcctcc

SEQ ID NO: 750 - DNA, 15 bp, Homo sapiens
cagatttctggcctc

SEQ ID NO: 751 - DNA, 15 bp, Homo sapiens
tcagatttctggcct

SEQ ID NO: 752 - DNA, 15 bp, Homo sapiens
ctcagatttctggcc

SEQ ID NO: 753 - DNA, 15 bp, Homo sapiens
tctcagatttctggc

SEQ ID NO: 754 - DNA, 15 bp, Homo sapiens
ctctcagatttctgg

SEQ ID NO: 755 - DNA, 15 bp, Homo sapiens
gctctcagatttctg

SEQ ID NO: 756 - DNA, 15 bp, Homo sapiens
tgctctcagatttct

SEQ ID NO: 757 - DNA, 15 bp, Homo sapiens
ttgctctcagatttc

SEQ ID NO: 758 - DNA, 15 bp, Homo sapiens
cttgctctcagattt

SEQ ID NO: 759 - DNA, 15 bp, Homo sapiens
tcttgctctcagatt

SEQ ID NO: 760 - DNA, 15 bp, Homo sapiens
atcttgctctcagat

SEQ ID NO: 761 - DNA, 15 bp, Homo sapiens
catcttgctctcaga

SEQ ID NO: 762 - DNA, 15 bp, Homo sapiens
acatcttgctctcag

SEQ ID NO: 763 - DNA, 15 bp, Homo sapiens
gacatcttgctctca

SEQ ID NO: 764 - DNA, 15 bp, Homo sapiens
tgacatcttgctctc

SEQ ID NO: 765 - DNA, 15 bp, Homo sapiens
ctgacatcttgctct

SEQ ID NO: 766 - DNA, 15 bp, Homo sapiens
gctgacatcttgctc

SEQ ID NO: 767 - DNA, 15 bp, Homo sapiens
agctgacatcttgct

SEQ ID NO: 768 - DNA, 15 bp, Homo sapiens
cagctgacatcttgc

SEQ ID NO: 769 - DNA, 15 bp, Homo sapiens
ccagctgacatcttg

SEQ ID NO: 770 - DNA, 15 bp, Homo sapiens
cccagctgacatctt

SEQ ID NO: 771 - DNA, 15 bp, Homo sapiens
gcccagctgacatct

SEQ ID NO: 772 - DNA, 15 bp, Homo sapiens
ggcccagctgacatc

SEQ ID NO: 773 - DNA, 15 bp, Homo sapiens
tggcccagctgacat

SEQ ID NO: 774 - DNA, 15 bp, Homo sapiens
gtggcccagctgaca

SEQ ID NO: 775 - DNA, 15 bp, Homo sapiens
tgtggcccagctgac

SEQ ID NO: 776 - DNA, 15 bp, Homo sapiens
gtgtggcccagctga

SEQ ID NO: 777 - DNA, 15 bp, Homo sapiens
ggtgtggcccagctg

SEQ ID NO: 778 - DNA, 15 bp, Homo sapiens
aggtgtggcccagct

SEQ ID NO: 779 - DNA, 15 bp, Homo sapiens
gaggtgtggcccagc

SEQ ID NO: 780 - DNA, 15 bp, Homo sapiens
ggaggtgtggcccag

SEQ ID NO: 781 - DNA, 15 bp, Homo sapiens
gggaggtgtggccca

SEQ ID NO: 782 - DNA, 15 bp, Homo sapiens
agggaggtgtggccc

SEQ ID NO: 783 - DNA, 15 bp, Homo sapiens
gagggaggtgtggcc

SEQ ID NO: 784 - DNA, 15 bp, Homo sapiens
agagggaggtgtggc

SEQ ID NO: 785 - DNA, 15 bp, Homo sapiens
cagagggaggtgtgg

SEQ ID NO: 786 - DNA, 15 bp, Homo sapiens
tcagagggaggtgtg

SEQ ID NO: 787 - DNA, 15 bp, Homo sapiens
ttcagagggaggtgt

SEQ ID NO: 788 - DNA, 15 bp, Homo sapiens
cttcagagggaggtg

SEQ ID NO: 789 - DNA, 15 bp, Homo sapiens
ccttcagagggaggt

SEQ ID NO: 790 - DNA, 15 bp, Homo sapiens
gccttcagagggagg

SEQ ID NO: 791 - DNA, 15 bp, Homo sapiens
agccttcagagggag

SEQ ID NO: 792 - DNA, 15 bp, Homo sapiens
gagccttcagaggga

SEQ ID NO: 793 - DNA, 15 bp, Homo sapiens
ggagccttcagaggg

SEQ ID NO: 794 - DNA, 15 bp, Homo sapiens
tggagccttcagagg

SEQ ID NO: 795 - DNA, 15 bp, Homo sapiens
ttggagccttcagag

SEQ ID NO: 796 - DNA, 15 bp, Homo sapiens
cttggagccttcaga

SEQ ID NO: 797 - DNA, 15 bp, Homo sapiens
ccttggagccttcag

SEQ ID NO: 798 - DNA, 15 bp, Homo sapiens
cccttggagccttca

SEQ ID NO: 799 - DNA, 15 bp, Homo sapiens
tcccttggagccttc

SEQ ID NO: 800 - DNA, 15 bp, Homo sapiens
ctcccttggagcctt

SEQ ID NO: 801 - DNA, 15 bp, Homo sapiens
tctcccttggagcct

SEQ ID NO: 802 - DNA, 15 bp, Homo sapiens
ttctcccttggagcc

SEQ ID NO: 803 - DNA, 15 bp, Homo sapiens
attctcccttggagc

SEQ ID NO: 804 - DNA, 15 bp, Homo sapiens
gattctcccttggag

SEQ ID NO: 805 - DNA, 15 bp, Homo sapiens
ggattctcccttgga

SEQ ID NO: 806 - DNA, 15 bp, Homo sapiens
aggattctcccttgg

SEQ ID NO: 807 - DNA, 15 bp, Homo sapiens
aaggattctcccttg

SEQ ID NO: 808 - DNA, 15 bp, Homo sapiens
caaggattctccctt

SEQ ID NO: 809 - DNA, 15 bp, Homo sapiens
gcaaggattctccct

SEQ ID NO: 810 - DNA, 15 bp, Homo sapiens
agcaaggattctccc

SEQ ID NO: 811 - DNA, 15 bp, Homo sapiens
aagcaaggattctcc

SEQ ID NO: 812 - DNA, 15 bp, Homo sapiens
aaagcaaggattctc

SEQ ID NO: 813 - DNA, 15 bp, Homo sapiens
gaaagcaaggattct

SEQ ID NO: 814 - DNA, 15 bp, Homo sapiens
ggaaagcaaggattc

SEQ ID NO: 815 - DNA, 15 bp, Homo sapiens
aggaaagcaaggatt

SEQ ID NO: 816 - DNA, 15 bp, Homo sapiens
gaggaaagcaaggat

SEQ ID NO: 817 - DNA, 15 bp, Homo sapiens
agaggaaagcaagga

SEQ ID NO: 818 - DNA, 15 bp, Homo sapiens
aagaggaaagcaagg

SEQ ID NO: 819 - DNA, 15 bp, Homo sapiens
gaagaggaaagcaag

SEQ ID NO: 820 - DNA, 15 bp, Homo sapiens
ggaagaggaaagcaa

SEQ ID NO: 821 - DNA, 15 bp, Homo sapiens
tggaagaggaaagca

SEQ ID NO: 822 - DNA, 15 bp, Homo sapiens
ctggaagaggaaagc

SEQ ID NO: 823 - DNA, 15 bp, Homo sapiens
gctggaagaggaaag

SEQ ID NO: 824 - DNA, 15 bp, Homo sapiens
agctggaagaggaaa

SEQ ID NO: 825 - DNA, 15 bp, Homo sapiens
cagctggaagaggaa

SEQ ID NO: 826 - DNA, 15 bp, Homo sapiens
gcagctggaagagga

SEQ ID NO: 827 - DNA, 15 bp, Homo sapiens
agcagctggaagagg

SEQ ID NO: 828 - DNA, 15 bp, Homo sapiens
cagcagctggaagag

SEQ ID NO: 829 - DNA, 15 bp, Homo sapiens
ccagcagctggaaga

SEQ ID NO: 830 - DNA, 15 bp, Homo sapiens
accagcagctggaag

SEQ ID NO: 831 - DNA, 15 bp, Homo sapiens
caccagcagctggaa

SEQ ID NO: 832 - DNA, 15 bp, Homo sapiens
ccaccagcagctgga

SEQ ID NO: 833 - DNA, 15 bp, Homo sapiens
gccaccagcagctgg

SEQ ID NO: 834 - DNA, 15 bp, Homo sapiens
agccaccagcagctg

SEQ ID NO: 835 - DNA, 15 bp, Homo sapiens
gagccaccagcagct

SEQ ID NO: 836 - DNA, 15 bp, Homo sapiens
ggagccaccagcagc

SEQ ID NO: 837 - DNA, 15 bp, Homo sapiens
tggagccaccagcag

SEQ ID NO: 838 - DNA, 15 bp, Homo sapiens
ctggagccaccagca

SEQ ID NO: 839 - DNA, 15 bp, Homo sapiens
cctggagccaccagc

SEQ ID NO: 840 - DNA, 15 bp, Homo sapiens
acctggagccaccag

SEQ ID NO: 841 - DNA, 15 bp, Homo sapiens
tacctggagccacca

SEQ ID NO: 842 - DNA, 15 bp, Homo sapiens
atacctggagccacc

SEQ ID NO: 843 - DNA, 15 bp, Homo sapiens
aatacctggagccac

SEQ ID NO: 844 - DNA, 15 bp, Homo sapiens
taatacctggagcca

SEQ ID NO: 845 - DNA, 15 bp, Homo sapiens
gtaatacctggagcc

SEQ ID NO: 846 - DNA, 15 bp, Homo sapiens
agtaatacctggagc

SEQ ID NO: 847 - DNA, 15 bp, Homo sapiens
aagtaatacctggag

SEQ ID NO: 848 - DNA, 15 bp, Homo sapiens
caagtaatacctgga

SEQ ID NO: 849 - DNA, 15 bp, Homo sapiens
ccaagtaatacctgg

SEQ ID NO: 850 - DNA, 15 bp, Homo sapiens
gccaagtaatacctg

SEQ ID NO: 851 - DNA, 15 bp, Homo sapiens
agccaagtaatacct

SEQ ID NO: 852 - DNA, 15 bp, Homo sapiens
aagccaagtaatacc

SEQ ID NO: 853 - DNA, 15 bp, Homo sapiens
taagccaagtaatac

SEQ ID NO: 854 - DNA, 15 bp, Homo sapiens
ataagccaagtaata

SEQ ID NO: 855 - DNA, 15 bp, Homo sapiens
cataagccaagtaat

SEQ ID NO: 856 - DNA, 15 bp, Homo sapiens
ccataagccaagtaa

SEQ ID NO: 857 - DNA, 15 bp, Homo sapiens
gccataagccaagta

SEQ ID NO: 858 - DNA, 15 bp, Homo sapiens
tgccataagccaagt

SEQ ID NO: 859 - DNA, 15 bp, Homo sapiens
ctgccataagccaag

SEQ ID NO: 860 - DNA, 15 bp, Homo sapiens
gctgccataagccaa

SEQ ID NO: 861 - DNA, 15 bp, Homo sapiens
tgctgccataagcca

SEQ ID NO: 862 - DNA, 15 bp, Homo sapiens
atgctgccataagcc

SEQ ID NO: 863 - DNA, 15 bp, Homo sapiens
tatgctgccataagc

SEQ ID NO: 864 - DNA, 15 bp, Homo sapiens
ttatgctgccataag

SEQ ID NO: 865 - DNA, 15 bp, Homo sapiens
gttatgctgccataa

SEQ ID NO: 866 - DNA, 15 bp, Homo sapiens
agttatgctgccata

SEQ ID NO: 867 - DNA, 15 bp, Homo sapiens
gagttatgctgccat

SEQ ID NO: 868 - DNA, 15 bp, Homo sapiens
ggagttatgctgcca

SEQ ID NO: 869 - DNA, 15 bp, Homo sapiens
aggagttatgctgcc

SEQ ID NO: 870 - DNA, 15 bp, Homo sapiens
taggagttatgctgc

SEQ ID NO: 871 - DNA, 15 bp, Homo sapiens
ataggagttatgctg

SEQ ID NO: 872 - DNA, 15 bp, Homo sapiens
gataggagttatgct

SEQ ID NO: 873 - DNA, 15 bp, Homo sapiens
agataggagttatgc

SEQ ID NO: 874 - DNA, 15 bp, Homo sapiens
gagataggagttatg

SEQ ID NO: 875 - DNA, 15 bp, Homo sapiens
agagataggagttat

SEQ ID NO: 876 - DNA, 15 bp, Homo sapiens
cagagataggagtta

SEQ ID NO: 877 - DNA, 15 bp, Homo sapiens
gcagagataggagtt

SEQ ID NO: 878 - DNA, 15 bp, Homo sapiens
ggcagagataggagt

SEQ ID NO: 879 - DNA, 15 bp, Homo sapiens
aggcagagataggag

SEQ ID NO: 880 - DNA, 15 bp, Homo sapiens
aaggcagagatagga

SEQ ID NO: 881 - DNA, 15 bp, Homo sapiens
aaaggcagagatagg

SEQ ID NO: 882 - DNA, 15 bp, Homo sapiens
caaaggcagagatag

SEQ ID NO: 883 - DNA, 15 bp, Homo sapiens
acaaaggcagagata

SEQ ID NO: 884 - DNA, 15 bp, Homo sapiens
gacaaaggcagagat

SEQ ID NO: 885 - DNA, 15 bp, Homo sapiens
agacaaaggcagaga

SEQ ID NO: 886 - DNA, 15 bp, Homo sapiens
aagacaaaggcagag

SEQ ID NO: 887 - DNA, 15 bp, Homo sapiens
aaagacaaaggcaga

SEQ ID NO: 888 - DNA, 15 bp, Homo sapiens
caaagacaaaggcag

SEQ ID NO: 889 - DNA, 15 bp, Homo sapiens
acaaagacaaaggca

SEQ ID NO: 890 - DNA, 15 bp, Homo sapiens
cacaaagacaaaggc

SEQ ID NO: 891 - DNA, 15 bp, Homo sapiens
ccacaaagacaaagg

SEQ ID NO: 892 - DNA, 15 bp, Homo sapiens
accacaaagacaaag

SEQ ID NO: 893 - DNA, 15 bp, Homo sapiens
gaccacaaagacaaa

SEQ ID NO: 894 - DNA, 15 bp, Homo sapiens
agaccacaaagacaa

SEQ ID NO: 895 - DNA, 15 bp, Homo sapiens
aagaccacaaagaca

SEQ ID NO: 896 - DNA, 15 bp, Homo sapiens
gaagaccacaaagac

SEQ ID NO: 897 - DNA, 15 bp, Homo sapiens
agaagaccacaaaga

SEQ ID NO: 898 - DNA, 15 bp, Homo sapiens
aagaagaccacaaag

SEQ ID NO: 899 - DNA, 15 bp, Homo sapiens
aaagaagaccacaaa

SEQ ID NO: 900 - DNA, 15 bp, Homo sapiens
aaaagaagaccacaa

SEQ ID NO: 901 - DNA, 15 bp, Homo sapiens
gaaaagaagaccaca

SEQ ID NO: 902 - DNA, 15 bp, Homo sapiens
agaaaagaagaccac

SEQ ID NO: 903 - DNA, 15 bp, Homo sapiens
cagaaaagaagacca

SEQ ID NO: 904 - DNA, 15 bp, Homo sapiens
acagaaaagaagacc

SEQ ID NO: 905 - DNA, 15 bp, Homo sapiens
gacagaaaagaagac

SEQ ID NO: 906 - DNA, 15 bp, Homo sapiens
agacagaaaagaaga

SEQ ID NO: 907 - DNA, 15 bp, Homo sapiens
aagacagaaaagaag

SEQ ID NO: 908 - DNA, 15 bp, Homo sapiens
gaagacagaaaagaa

SEQ ID NO: 909 - DNA, 15 bp, Homo sapiens
agaagacagaaaaga

SEQ ID NO: 910 - DNA, 15 bp, Homo sapiens
aagaagacagaaaag

SEQ ID NO: 911 - DNA, 15 bp, Homo sapiens
gaagaagacagaaaa

SEQ ID NO: 912 - DNA, 15 bp, Homo sapiens
ggaagaagacagaaa

SEQ ID NO: 913 - DNA, 15 bp, Homo sapiens
gggaagaagacagaa

SEQ ID NO: 914 - DNA, 15 bp, Homo sapiens
agggaagaagacaga

SEQ ID NO: 915 - DNA, 15 bp, Homo sapiens
aagggaagaagacag

SEQ ID NO: 916 - DNA, 15 bp, Homo sapiens
gaagggaagaagaca

SEQ ID NO: 917 - DNA, 15 bp, Homo sapiens
agaagggaagaagac

SEQ ID NO: 918 - DNA, 15 bp, Homo sapiens
aagaagggaagaaga

SEQ ID NO: 919 - DNA, 15 bp, Homo sapiens
aaagaagggaagaag

SEQ ID NO: 920 - DNA, 15 bp, Homo sapiens
aaaagaagggaagaa

SEQ ID NO: 921 - DNA, 15 bp, Homo sapiens
aaaaagaagggaaga

SEQ ID NO: 922 - DNA, 15 bp, Homo sapiens
taaaaagaagggaag

SEQ ID NO: 923 - DNA, 15 bp, Homo sapiens
ataaaaagaagggaa

SEQ ID NO: 924 - DNA, 15 bp, Homo sapiens
cataaaaagaaggga

SEQ ID NO: 925 - DNA, 15 bp, Homo sapiens
tcataaaaagaaggg

SEQ ID NO: 926 - DNA, 15 bp, Homo sapiens
ctcataaaaagaagg

SEQ ID NO: 927 - DNA, 15 bp, Homo sapiens
cctcataaaaagaag

SEQ ID NO: 928 - DNA, 15 bp, Homo sapiens
tcctcataaaaagaa

SEQ ID NO: 929 - DNA, 15 bp, Homo sapiens
gtcctcataaaaaga

SEQ ID NO: 930 - DNA, 15 bp, Homo sapiens
agtcctcataaaaag

SEQ ID NO: 931 - DNA, 15 bp, Homo sapiens
aagtcctcataaaaa

SEQ ID NO: 932 - DNA, 15 bp, Homo sapiens
aaagtcctcataaaa

SEQ ID NO: 933 - DNA, 15 bp, Homo sapiens
aaaagtcctcataaa

SEQ ID NO: 934 - DNA, 15 bp, Homo sapiens
caaaagtcctcataa

SEQ ID NO: 935 - DNA, 15 bp, Homo sapiens
gcaaaagtcctcata

SEQ ID NO: 936 - DNA, 15 bp, Homo sapiens
agcaaaagtcctcat

SEQ ID NO: 937 - DNA, 15 bp, Homo sapiens
cagcaaaagtcctca

SEQ ID NO: 938 - DNA, 15 bp, Homo sapiens
acagcaaaagtcctc

SEQ ID NO: 939 - DNA, 15 bp, Homo sapiens
aacagcaaaagtcct

SEQ ID NO: 940 - DNA, 15 bp, Homo sapiens
caacagcaaaagtcc

SEQ ID NO: 941 - DNA, 15 bp, Homo sapiens
ccaacagcaaaagtc

SEQ ID NO: 942 - DNA, 15 bp, Homo sapiens
tccaacagcaaaagt

SEQ ID NO: 943 - DNA, 15 bp, Homo sapiens
atccaacagcaaaag

SEQ ID NO: 944 - DNA, 15 bp, Homo sapiens
aatccaacagcaaaa

SEQ ID NO: 945 - DNA, 15 bp, Homo sapiens
aaatccaacagcaaa

SEQ ID NO: 946 - DNA, 15 bp, Homo sapiens
taaatccaacagcaa

SEQ ID NO: 947 - DNA, 15 bp, Homo sapiens
ctaaatccaacagca

SEQ ID NO: 948 - DNA, 15 bp, Homo sapiens
cctaaatccaacagc

SEQ ID NO: 949 - DNA, 15 bp, Homo sapiens
acctaaatccaacag

SEQ ID NO: 950 - DNA, 15 bp, Homo sapiens
aacctaaatccaaca

SEQ ID NO: 951 - DNA, 15 bp, Homo sapiens
gaacctaaatccaac

SEQ ID NO: 952 - DNA, 15 bp, Homo sapiens
ggaacctaaatccaa

SEQ ID NO: 953 - DNA, 15 bp, Homo sapiens
tggaacctaaatcca

SEQ ID NO: 954 - DNA, 15 bp, Homo sapiens
atggaacctaaatcc

SEQ ID NO: 955 - DNA, 15 bp, Homo sapiens
aatggaacctaaatc

SEQ ID NO: 956 - DNA, 15 bp, Homo sapiens
gaatggaacctaaat

SEQ ID NO: 957 - DNA, 15 bp, Homo sapiens
agaatggaacctaaa

SEQ ID NO: 958 - DNA, 15 bp, Homo sapiens
tagaatggaacctaa

SEQ ID NO: 959 - DNA, 15 bp, Homo sapiens
ttagaatggaaccta

SEQ ID NO: 960 - DNA, 15 bp, Homo sapiens
gttagaatggaacct

SEQ ID NO: 961 - DNA, 15 bp, Homo sapiens
ggttagaatggaacc

SEQ ID NO: 962 - DNA, 15 bp, Homo sapiens
aggttagaatggaac

SEQ ID NO: 963 - DNA, 15 bp, Homo sapiens
taggttagaatggaa

SEQ ID NO: 964 - DNA, 15 bp, Homo sapiens
ctaggttagaatgga

SEQ ID NO: 965 - DNA, 15 bp, Homo sapiens
cctaggttagaatgg

SEQ ID NO: 966 - DNA, 15 bp, Homo sapiens
tcctaggttagaatg

SEQ ID NO: 967 - DNA, 15 bp, Homo sapiens
atcctaggttagaat

SEQ ID NO: 968 - DNA, 15 bp, Homo sapiens
catcctaggttagaa

SEQ ID NO: 969 - DNA, 15 bp, Homo sapiens
tcatcctaggttaga

SEQ ID NO: 970 - DNA, 15 bp, Homo sapiens
atcatcctaggttag

SEQ ID NO: 971 - DNA, 15 bp, Homo sapiens
gatcatcctaggtta

SEQ ID NO: 972 - DNA, 15 bp, Homo sapiens
agatcatcctaggtt

SEQ ID NO: 973 - DNA, 15 bp, Homo sapiens
gagatcatcctaggt

SEQ ID NO: 974 - DNA, 15 bp, Homo sapiens
tgagatcatcctagg

SEQ ID NO: 975 - DNA, 15 bp, Homo sapiens
atgagatcatcctag

SEQ ID NO: 976 - DNA, 15 bp, Homo sapiens
aatgagatcatccta

SEQ ID NO: 977 - DNA, 15 bp, Homo sapiens
aaatgagatcatcct

SEQ ID NO: 978 - DNA, 15 bp, Homo sapiens
caaatgagatcatcc

SEQ ID NO: 979 - DNA, 15 bp, Homo sapiens
ccaaatgagatcatc

SEQ ID NO: 980 - DNA, 15 bp, Homo sapiens
tccaaatgagatcat

SEQ ID NO: 981 - DNA, 15 bp, Homo sapiens
ttccaaatgagatca

SEQ ID NO: 982 - DNA, 15 bp, Homo sapiens
tttccaaatgagatc

SEQ ID NO: 983 - DNA, 15 bp, Homo sapiens
atttccaaatgagat

SEQ ID NO: 984 - DNA, 15 bp, Homo sapiens
gatttccaaatgaga

SEQ ID NO: 985 - DNA, 15 bp, Homo sapiens
ggatttccaaatgag

SEQ ID NO: 986 - DNA, 15 bp, Homo sapiens
aggatttccaaatga

SEQ ID NO: 987 - DNA, 15 bp, Homo sapiens
aaggatttccaaatg

SEQ ID NO: 988 - DNA, 15 bp, Homo sapiens
taaggatttccaaat

SEQ ID NO: 989 - DNA, 15 bp, Homo sapiens
ttaaggatttccaaa

SEQ ID NO: 990 - DNA, 15 bp, Homo sapiens
attaaggatttccaa

SEQ ID NO: 991 - DNA, 15 bp, Homo sapiens
aattaaggatttcca

SEQ ID NO: 992 - DNA, 15 bp, Homo sapiens
aaattaaggatttcc

SEQ ID NO: 993 - DNA, 15 bp, Homo sapiens
gaaattaaggatttc

SEQ ID NO: 994 - DNA, 15 bp, Homo sapiens
tgaaattaaggattt

SEQ ID NO: 995 - DNA, 15 bp, Homo sapiens
atgaaattaaggatt

SEQ ID NO: 996 - DNA, 15 bp, Homo sapiens
gatgaaattaaggat

SEQ ID NO: 997 - DNA, 15 bp, Homo sapiens
agatgaaattaagga

SEQ ID NO: 998 - DNA, 15 bp, Homo sapiens
tagatgaaattaagg

SEQ ID NO: 999 - DNA, 15 bp, Homo sapiens
gtagatgaaattaag

SEQ ID NO: 1000 - DNA, 15 bp, Homo sapiens
tgtagatgaaattaa

SEQ ID NO: 1001 - DNA, 15 bp, Homo sapiens
ttgtagatgaaatta

SEQ ID NO: 1002 - DNA, 15 bp, Homo sapiens
tttgtagatgaaatt

SEQ ID NO: 1003 - DNA, 15 bp, Homo sapiens
ttttgtagatgaaat

SEQ ID NO: 1004 - DNA, 15 bp, Homo sapiens
tttttgtagatgaaa

SEQ ID NO: 1005 - DNA, 15 bp, Homo sapiens
gtttttgtagatgaa

SEQ ID NO: 1006 - DNA, 15 bp, Homo sapiens
agtttttgtagatga

SEQ ID NO: 1007 - DNA, 15 bp, Homo sapiens
cagtttttgtagatg

SEQ ID NO: 1008 - DNA, 15 bp, Homo sapiens
acagtttttgtagat

SEQ ID NO: 1009 - DNA, 15 bp, Homo sapiens
aacagtttttgtaga

SEQ ID NO: 1010 - DNA, 15 bp, Homo sapiens
aaacagtttttgtag

SEQ ID NO: 1011 - DNA, 15 bp, Homo sapiens
aaaacagtttttgta

SEQ ID NO: 1012 - DNA, 15 bp, Homo sapiens
gaaaacagtttttgt

SEQ ID NO: 1013 - DNA, 15 bp, Homo sapiens
ggaaaacagtttttg

SEQ ID NO: 1014 - DNA, 15 bp, Homo sapiens
gggaaaacagttttt

SEQ ID NO: 1015 - DNA, 15 bp, Homo sapiens
tgggaaaacagtttt

SEQ ID NO: 1016 - DNA, 15 bp, Homo sapiens
ttgggaaaacagttt

SEQ ID NO: 1017 - DNA, 15 bp, Homo sapiens
tttgggaaaacagtt

SEQ ID NO: 1018 - DNA, 15 bp, Homo sapiens
atttgggaaaacagt

SEQ ID NO: 1019 - DNA, 15 bp, Homo sapiens
tatttgggaaaacag

SEQ ID NO: 1020 - DNA, 15 bp, Homo sapiens
ctatttgggaaaaca

SEQ ID NO: 1021 - DNA, 15 bp, Homo sapiens
cctatttgggaaaac

SEQ ID NO: 1022 - DNA, 15 bp, Homo sapiens
acctatttgggaaaa

SEQ ID NO: 1023 - DNA, 15 bp, Homo sapiens
gacctatttgggaaa

SEQ ID NO: 1024 - DNA, 15 bp, Homo sapiens
tgacctatttgggaa

SEQ ID NO: 1025 - DNA, 15 bp, Homo sapiens
gtgacctatttggga

SEQ ID NO: 1026 - DNA, 15 bp, Homo sapiens
tgtgacctatttggg

SEQ ID NO: 1027 - DNA, 15 bp, Homo sapiens
atgtgacctatttgg

SEQ ID NO: 1028 - DNA, 15 bp, Homo sapiens
aatgtgacctatttg

SEQ ID NO: 1029 - DNA, 15 bp, Homo sapiens
gaatgtgacctattt

SEQ ID NO: 1030 - DNA, 15 bp, Homo sapiens
tgaatgtgacctatt

SEQ ID NO: 1031 - DNA, 15 bp, Homo sapiens
gtgaatgtgacctat

SEQ ID NO: 1032 - DNA, 15 bp, Homo sapiens
cgtgaatgtgaccta

SEQ ID NO: 1033 - DNA, 15 bp, Homo sapiens
gcgtgaatgtgacct

SEQ ID NO: 1034 - DNA, 15 bp, Homo sapiens
tgcgtgaatgtgacc

SEQ ID NO: 1035 - DNA, 15 bp, Homo sapiens
atgcgtgaatgtgac

SEQ ID NO: 1036 - DNA, 15 bp, Homo sapiens
tatgcgtgaatgtga

SEQ ID NO: 1037 - DNA, 15 bp, Homo sapiens
atatgcgtgaatgtg

SEQ ID NO: 1038 - DNA, 15 bp, Homo sapiens
gatatgcgtgaatgt

SEQ ID NO: 1039 - DNA, 15 bp, Homo sapiens
tgatatgcgtgaatg

SEQ ID NO: 1040 - DNA, 15 bp, Homo sapiens
ctgatatgcgtgaat

SEQ ID NO: 1041 - DNA, 15 bp, Homo sapiens
tctgatatgcgtgaa

SEQ ID NO: 1042 - DNA, 15 bp, Homo sapiens
atctgatatgcgtga

SEQ ID NO: 1043 - DNA, 15 bp, Homo sapiens
catctgatatgcgtg

SEQ ID NO: 1044 - DNA, 15 bp, Homo sapiens
ccatctgatatgcgt

SEQ ID NO: 1045 - DNA, 15 bp, Homo sapiens
tccatctgatatgcg

SEQ ID NO: 1046 - DNA, 15 bp, Homo sapiens
gtccatctgatatgc

SEQ ID NO: 1047 - DNA, 15 bp, Homo sapiens
tgtccatctgatatg

SEQ ID NO: 1048 - DNA, 15 bp, Homo sapiens
ctgtccatctgatat

SEQ ID NO: 1049 - DNA, 15 bp, Homo sapiens
tctgtccatctgata

SEQ ID NO: 1050 - DNA, 15 bp, Homo sapiens
atctgtccatctgat

SEQ ID NO: 1051 - DNA, 15 bp, Homo sapiens
catctgtccatctga

SEQ ID NO: 1052 - DNA, 15 bp, Homo sapiens
acatctgtccatctg

SEQ ID NO: 1053 - DNA, 15 bp, Homo sapiens
tacatctgtccatct

SEQ ID NO: 1054 - DNA, 15 bp, Homo sapiens
atacatctgtccatc

SEQ ID NO: 1055 - DNA, 15 bp, Homo sapiens
gatacatctgtccat

SEQ ID NO: 1056 - DNA, 15 bp, Homo sapiens
tgatacatctgtcca

SEQ ID NO: 1057 - DNA, 15 bp, Homo sapiens
atgatacatctgtcc

SEQ ID NO: 1058 - DNA, 15 bp, Homo sapiens
aatgatacatctgtc

SEQ ID NO: 1059 - DNA, 15 bp, Homo sapiens
aaatgatacatctgt

SEQ ID NO: 1060 - DNA, 15 bp, Homo sapiens
aaaatgatacatctg

SEQ ID NO: 1061 - DNA, 15 bp, Homo sapiens
caaaatgatacatct

SEQ ID NO: 1062 - DNA, 15 bp, Homo sapiens
ccaaaatgatacatc

SEQ ID NO: 1063 - DNA, 15 bp, Homo sapiens
cccaaaatgatacat

SEQ ID NO: 1064 - DNA, 15 bp, Homo sapiens
ccccaaaatgataca

SEQ ID NO: 1065 - DNA, 15 bp, Homo sapiens
accccaaaatgatac

SEQ ID NO: 1066 - DNA, 15 bp, Homo sapiens
gaccccaaaatgata

SEQ ID NO: 1067 - DNA, 15 bp, Homo sapiens
ggaccccaaaatgat

SEQ ID NO: 1068 - DNA, 15 bp, Homo sapiens
tggaccccaaaatga

SEQ ID NO: 1069 - DNA, 15 bp, Homo sapiens
gtggaccccaaaatg

SEQ ID NO: 1070 - DNA, 15 bp, Homo sapiens
ggtggaccccaaaat

SEQ ID NO: 1071 - DNA, 15 bp, Homo sapiens
tggtggaccccaaaa

SEQ ID NO: 1072 - DNA, 15 bp, Homo sapiens
atggtggaccccaaa

SEQ ID NO: 1073 - DNA, 15 bp, Homo sapiens
aatggtggaccccaa

SEQ ID NO: 1074 - DNA, 15 bp, Homo sapiens
gaatggtggacccca

SEQ ID NO: 1075 - DNA, 15 bp, Homo sapiens
tgaatggtggacccc

SEQ ID NO: 1076 - DNA, 15 bp, Homo sapiens
ttgaatggtggaccc

SEQ ID NO: 1077 - DNA, 15 bp, Homo sapiens
gttgaatggtggacc

SEQ ID NO: 1078 - DNA, 15 bp, Homo sapiens
ggttgaatggtggac

SEQ ID NO: 1079 - DNA, 15 bp, Homo sapiens
gggttgaatggtgga

SEQ ID NO: 1080 - DNA, 15 bp, Homo sapiens
tgggttgaatggtgg

SEQ ID NO: 1081 - DNA, 15 bp, Homo sapiens
gtgggttgaatggtg

SEQ ID NO: 1082 - DNA, 15 bp, Homo sapiens
agtgggttgaatggt

SEQ ID NO: 1083 - DNA, 15 bp, Homo sapiens
tagtgggttgaatgg

SEQ ID NO: 1084 - DNA, 15 bp, Homo sapiens
gtagtgggttgaatg

SEQ ID NO: 1085 - DNA, 15 bp, Homo sapiens
tgtagtgggttgaat

SEQ ID NO: 1086 - DNA, 15 bp, Homo sapiens
ttgtagtgggttgaa

SEQ ID NO: 1087 - DNA, 15 bp, Homo sapiens
cttgtagtgggttga

SEQ ID NO: 1088 - DNA, 15 bp, Homo sapiens
ccttgtagtgggttg

SEQ ID NO: 1089 - DNA, 15 bp, Homo sapiens
tccttgtagtgggtt

SEQ ID NO: 1090 - DNA, 15 bp, Homo sapiens
ctccttgtagtgggt

SEQ ID NO: 1091 - DNA, 15 bp, Homo sapiens
actccttgtagtggg

SEQ ID NO: 1092 - DNA, 15 bp, Homo sapiens
aactccttgtagtgg

SEQ ID NO: 1093 - DNA, 15 bp, Homo sapiens
aaactccttgtagtg

SEQ ID NO: 1094 - DNA, 15 bp, Homo sapiens
aaaactccttgtagt

SEQ ID NO: 1095 - DNA, 15 bp, Homo sapiens
aaaaactccttgtag

SEQ ID NO: 1096 - DNA, 15 bp, Homo sapiens
aaaaaactccttgta

SEQ ID NO: 1097 - DNA, 15 bp, Homo sapiens
taaaaaactccttgt

SEQ ID NO: 1098 - DNA, 15 bp, Homo sapiens
ttaaaaaactccttg

SEQ ID NO: 1099 - DNA, 15 bp, Homo sapiens
tttaaaaaactcctt

SEQ ID NO: 1100 - DNA, 15 bp, Homo sapiens
gtttaaaaaactcct

SEQ ID NO: 1101 - DNA, 15 bp, Homo sapiens
tgtttaaaaaactcc

SEQ ID NO: 1102 - DNA, 15 bp, Homo sapiens
ttgtttaaaaaactc

SEQ ID NO: 1103 - DNA, 15 bp, Homo sapiens
tttgtttaaaaaact

SEQ ID NO: 1104 - DNA, 15 bp, Homo sapiens
ttttgtttaaaaaac

SEQ ID NO: 1105 - DNA, 15 bp, Homo sapiens
tttttgtttaaaaaa

SEQ ID NO: 1106 - DNA, 15 bp, Homo sapiens
atttttgtttaaaaa

SEQ ID NO: 1107 - DNA, 15 bp, Homo sapiens
tatttttgtttaaaa

SEQ ID NO: 1108 - DNA, 15 bp, Homo sapiens
ctatttttgtttaaa

SEQ ID NO: 1109 - DNA, 15 bp, Homo sapiens
cctatttttgtttaa

SEQ ID NO: 1110 - DNA, 15 bp, Homo sapiens
tcctatttttgttta

SEQ ID NO: 1111 - DNA, 15 bp, Homo sapiens
ttcctatttttgttt

SEQ ID NO: 1112 - DNA, 15 bp, Homo sapiens
tttcctatttttgtt

SEQ ID NO: 1113 - DNA, 15 bp, Homo sapiens
gtttcctatttttgt

SEQ ID NO: 1114 - DNA, 15 bp, Homo sapiens
agtttcctatttttg

SEQ ID NO: 1115 - DNA, 15 bp, Homo sapiens
aagtttcctattttt

SEQ ID NO: 1116 - DNA, 15 bp, Homo sapiens
taagtttcctatttt

SEQ ID NO: 1117 - DNA, 15 bp, Homo sapiens
ctaagtttcctattt

SEQ ID NO: 1118 - DNA, 15 bp, Homo sapiens
tctaagtttcctatt

SEQ ID NO: 1119 - DNA, 15 bp, Homo sapiens
atctaagtttcctat

SEQ ID NO: 1120 - DNA, 15 bp, Homo sapiens
catctaagtttccta

SEQ ID NO: 1121 - DNA, 15 bp, Homo sapiens
acatctaagtttcct

SEQ ID NO: 1122 - DNA, 15 bp, Homo sapiens
tacatctaagtttcc

SEQ ID NO: 1123 - DNA, 15 bp, Homo sapiens
ttacatctaagtttc

SEQ ID NO: 1124 - DNA, 15 bp, Homo sapiens
gttacatctaagttt

SEQ ID NO: 1125 - DNA, 15 bp, Homo sapiens
agttacatctaagtt

SEQ ID NO: 1126 - DNA, 15 bp, Homo sapiens
aagttacatctaagt

SEQ ID NO: 1127 - DNA, 15 bp, Homo sapiens
taagttacatctaag

SEQ ID NO: 1128 - DNA, 15 bp, Homo sapiens
ctaagttacatctaa

SEQ ID NO: 1129 - DNA, 15 bp, Homo sapiens
gctaagttacatcta

SEQ ID NO: 1130 - DNA, 15 bp, Homo sapiens
tgctaagttacatct

SEQ ID NO: 1131 - DNA, 15 bp, Homo sapiens
gtgctaagttacatc

SEQ ID NO: 1132 - DNA, 15 bp, Homo sapiens
agtgctaagttacat

SEQ ID NO: 1133 - DNA, 15 bp, Homo sapiens
aagtgctaagttaca

SEQ ID NO: 1134 - DNA, 15 bp, Homo sapiens
aaagtgctaagttac

SEQ ID NO: 1135 - DNA, 15 bp, Homo sapiens
aaaagtgctaagtta

SEQ ID NO: 1136 - DNA, 15 bp, Homo sapiens
aaaaagtgctaagtt

SEQ ID NO: 1137 - DNA, 15 bp, Homo sapiens
aaaaaagtgctaagt

SEQ ID NO: 1138 - DNA, 15 bp, Homo sapiens
aaaaaaagtgctaag

SEQ ID NO: 1139 - DNA, 15 bp, Homo sapiens
aaaaaaaagtgctaa

SEQ ID NO: 1140 - DNA, 15 bp, Homo sapiens
aaaaaaaaagtgcta

SEQ ID NO: 1141 - DNA, 15 bp, Homo sapiens
aaaaaaaaaagtgct

SEQ ID NO: 1142 - DNA, 15 bp, Homo sapiens
aaaaaaaaaaagtgc

SEQ ID NO: 1143 - DNA, 15 bp, Homo sapiens
aaaaaaaaaaaagtg

SEQ ID NO: 1144 - DNA, 15 bp, Homo sapiens
aaaaaaaaaaaaagt

SEQ ID NO: 1145 - DNA, 15 bp, Homo sapiens
aaaaaaaaaaaaaag

SEQ ID NO: 1146 - DNA, 15 bp, Homo sapiens
aaaaaaaaaaaaaaa

SEQ ID NO: 1147 - DNA, 15 bp, Homo sapiens
caaaaaaaaaaaaaa

SEQ ID NO: 1148 - DNA, 15 bp, Homo sapiens
tcaaaaaaaaaaaaa

SEQ ID NO: 1149 - DNA, 15 bp, Homo sapiens
ctcaaaaaaaaaaaa

SEQ ID NO: 1150 - DNA, 15 bp, Homo sapiens
tctcaaaaaaaaaaa

SEQ ID NO: 1151 - DNA, 15 bp, Homo sapiens
atctcaaaaaaaaaa

SEQ ID NO: 1152 - DNA, 15 bp, Homo sapiens
catctcaaaaaaaaa

SEQ ID NO: 1153 - DNA, 15 bp, Homo sapiens
ccatctcaaaaaaaa

SEQ ID NO: 1154 - DNA, 15 bp, Homo sapiens
tccatctcaaaaaaa

SEQ ID NO: 1155 - DNA, 15 bp, Homo sapiens
ctccatctcaaaaaa

SEQ ID NO: 1156 - DNA, 15 bp, Homo sapiens
actccatctcaaaaa

SEQ ID NO: 1157 - DNA, 15 bp, Homo sapiens
gactccatctcaaaa

SEQ ID NO: 1158 - DNA, 15 bp, Homo sapiens
agactccatctcaaa

SEQ ID NO: 1159 - DNA, 15 bp, Homo sapiens
gagactccatctcaa

SEQ ID NO: 1160 - DNA, 15 bp, Homo sapiens
tgagactccatctca

SEQ ID NO: 1161 - DNA, 15 bp, Homo sapiens
gtgagactccatctc

SEQ ID NO: 1162 - DNA, 15 bp, Homo sapiens
agtgagactccatct

SEQ ID NO: 1163 - DNA, 15 bp, Homo sapiens
gagtgagactccatc

SEQ ID NO: 1164 - DNA, 15 bp, Homo sapiens
agagtgagactccat

SEQ ID NO: 1165 - DNA, 15 bp, Homo sapiens
cagagtgagactcca

SEQ ID NO: 1166 - DNA, 15 bp, Homo sapiens
acagagtgagactcc

SEQ ID NO: 1167 - DNA, 15 bp, Homo sapiens
gacagagtgagactc

SEQ ID NO: 1168 - DNA, 15 bp, Homo sapiens
tgacagagtgagact

SEQ ID NO: 1169 - DNA, 15 bp, Homo sapiens
gtgacagagtgagac

SEQ ID NO: 1170 - DNA, 15 bp, Homo sapiens
ggtgacagagtgaga

SEQ ID NO: 1171 - DNA, 15 bp, Homo sapiens
tggtgacagagtgag

SEQ ID NO: 1172 - DNA, 15 bp, Homo sapiens
ctggtgacagagtga

SEQ ID NO: 1173 - DNA, 15 bp, Homo sapiens
tctggtgacagagtg

SEQ ID NO: 1174 - DNA, 15 bp, Homo sapiens
gtctggtgacagagt

SEQ ID NO: 1175 - DNA, 15 bp, Homo sapiens
agtctggtgacagag

SEQ ID NO: 1176 - DNA, 15 bp, Homo sapiens
cagtctggtgacaga

SEQ ID NO: 1177 - DNA, 15 bp, Homo sapiens
ccagtctggtgacag

SEQ ID NO: 1178 - DNA, 15 bp, Homo sapiens
tccagtctggtgaca

SEQ ID NO: 1179 - DNA, 15 bp, Homo sapiens
ctccagtctggtgac

SEQ ID NO: 1180 - DNA, 15 bp, Homo sapiens
actccagtctggtga

SEQ ID NO: 1181 - DNA, 15 bp, Homo sapiens
cactccagtctggtg

SEQ ID NO: 1182 - DNA, 15 bp, Homo sapiens
gcactccagtctggt

SEQ ID NO: 1183 - DNA, 15 bp, Homo sapiens
tgcactccagtctgg

SEQ ID NO: 1184 - DNA, 15 bp, Homo sapiens
ctgcactccagtctg

SEQ ID NO: 1185 - DNA, 15 bp, Homo sapiens
actgcactccagtct

SEQ ID NO: 1186 - DNA, 15 bp, Homo sapiens
cactgcactccagtc

SEQ ID NO: 1187 - DNA, 15 bp, Homo sapiens
ccactgcactccagt

SEQ ID NO: 1188 - DNA, 15 bp, Homo sapiens
accactgcactccag

SEQ ID NO: 1189 - DNA, 15 bp, Homo sapiens
caccactgcactcca

SEQ ID NO: 1190 - DNA, 15 bp, Homo sapiens
gcaccactgcactcc

SEQ ID NO: 1191 - DNA, 15 bp, Homo sapiens
ggcaccactgcactc

SEQ ID NO: 1192 - DNA, 15 bp, Homo sapiens
tggcaccactgcact

SEQ ID NO: 1193 - DNA, 15 bp, Homo sapiens
atggcaccactgcac

SEQ ID NO: 1194 - DNA, 15 bp, Homo sapiens
gatggcaccactgca

SEQ ID NO: 1195 - DNA, 15 bp, Homo sapiens
agatggcaccactgc

SEQ ID NO: 1196 - DNA, 15 bp, Homo sapiens
gagatggcaccactg

SEQ ID NO: 1197 - DNA, 15 bp, Homo sapiens
tgagatggcaccact

SEQ ID NO: 1198 - DNA, 15 bp, Homo sapiens
ctgagatggcaccac

SEQ ID NO: 1199 - DNA, 15 bp, Homo sapiens
gctgagatggcacca

SEQ ID NO: 1200 - DNA, 15 bp, Homo sapiens
agctgagatggcacc

SEQ ID NO: 1201 - DNA, 15 bp, Homo sapiens
gagctgagatggcac

SEQ ID NO: 1202 - DNA, 15 bp, Homo sapiens
ggagctgagatggca

SEQ ID NO: 1203 - DNA, 15 bp, Homo sapiens
tggagctgagatggc

SEQ ID NO: 1204 - DNA, 15 bp, Homo sapiens
atggagctgagatgg

SEQ ID NO: 1205 - DNA, 15 bp, Homo sapiens
catggagctgagatg

SEQ ID NO: 1206 - DNA, 15 bp, Homo sapiens
gcatggagctgagat

SEQ ID NO: 1207 - DNA, 15 bp, Homo sapiens
tgcatggagctgaga

SEQ ID NO: 1208 - DNA, 15 bp, Homo sapiens
ttgcatggagctgag

SEQ ID NO: 1209 - DNA, 15 bp, Homo sapiens
gttgcatggagctga

SEQ ID NO: 1210 - DNA, 15 bp, Homo sapiens
ggttgcatggagctg

SEQ ID NO: 1211 - DNA, 15 bp, Homo sapiens
aggttgcatggagct

SEQ ID NO: 1212 - DNA, 15 bp, Homo sapiens
gaggttgcatggagc

SEQ ID NO: 1213 - DNA, 15 bp, Homo sapiens
agaggttgcatggag

SEQ ID NO: 1214 - DNA, 15 bp, Homo sapiens
cagaggttgcatgga

SEQ ID NO: 1215 - DNA, 15 bp, Homo sapiens
gcagaggttgcatgg

SEQ ID NO: 1216 - DNA, 15 bp, Homo sapiens
ggcagaggttgcatg

SEQ ID NO: 1217 - DNA, 15 bp, Homo sapiens
aggcagaggttgcat

SEQ ID NO: 1218 - DNA, 15 bp, Homo sapiens
gaggcagaggttgca

SEQ ID NO: 1219 - DNA, 15 bp, Homo sapiens
ggaggcagaggttgc

SEQ ID NO: 1220 - DNA, 15 bp, Homo sapiens
aggaggcagaggttg

SEQ ID NO: 1221 - DNA, 15 bp, Homo sapiens
caggaggcagaggtt

SEQ ID NO: 1222 - DNA, 15 bp, Homo sapiens
ccaggaggcagaggt

SEQ ID NO: 1223 - DNA, 15 bp, Homo sapiens
cccaggaggcagagg

SEQ ID NO: 1224 - DNA, 15 bp, Homo sapiens
acccaggaggcagag

SEQ ID NO: 1225 - DNA, 15 bp, Homo sapiens
aacccaggaggcaga

SEQ ID NO: 1226 - DNA, 15 bp, Homo sapiens
gaacccaggaggcag

SEQ ID NO: 1227 - DNA, 15 bp, Homo sapiens
tgaacccaggaggca

SEQ ID NO: 1228 - DNA, 15 bp, Homo sapiens
ttgaacccaggaggc

SEQ ID NO: 1229 - DNA, 15 bp, Homo sapiens
cttgaacccaggagg

SEQ ID NO: 1230 - DNA, 15 bp, Homo sapiens
gcttgaacccaggag

SEQ ID NO: 1231 - DNA, 15 bp, Homo sapiens
tgcttgaacccagga

SEQ ID NO: 1232 - DNA, 15 bp, Homo sapiens
ctgcttgaacccagg

SEQ ID NO: 1233 - DNA, 15 bp, Homo sapiens
actgcttgaacccag

SEQ ID NO: 1234 - DNA, 15 bp, Homo sapiens
aactgcttgaaccca

SEQ ID NO: 1235 - DNA, 15 bp, Homo sapiens
gaactgcttgaaccc

SEQ ID NO: 1236 - DNA, 15 bp, Homo sapiens
agaactgcttgaacc

SEQ ID NO: 1237 - DNA, 15 bp, Homo sapiens
gagaactgcttgaac

SEQ ID NO: 1238 - DNA, 15 bp, Homo sapiens
agagaactgcttgaa

SEQ ID NO: 1239 - DNA, 15 bp, Homo sapiens
aagagaactgcttga

SEQ ID NO: 1240 - DNA, 15 bp, Homo sapiens
caagagaactgcttg

SEQ ID NO: 1241 - DNA, 15 bp, Homo sapiens
gcaagagaactgctt

SEQ ID NO: 1242 - DNA, 15 bp, Homo sapiens
ggcaagagaactgct

SEQ ID NO: 1243 - DNA, 15 bp, Homo sapiens
aggcaagagaactgc

SEQ ID NO: 1244 - DNA, 15 bp, Homo sapiens
gaggcaagagaactg

SEQ ID NO: 1245 - DNA, 15 bp, Homo sapiens
tgaggcaagagaact

SEQ ID NO: 1246 - DNA, 15 bp, Homo sapiens
ctgaggcaagagaac

SEQ ID NO: 1247 - DNA, 15 bp, Homo sapiens
gctgaggcaagagaa

SEQ ID NO: 1248 - DNA, 15 bp, Homo sapiens
ggctgaggcaagaga

SEQ ID NO: 1249 - DNA, 15 bp, Homo sapiens
aggctgaggcaagag

SEQ ID NO: 1250 - DNA, 15 bp, Homo sapiens
gaggctgaggcaaga

SEQ ID NO: 1251 - DNA, 15 bp, Homo sapiens
ggaggctgaggcaag

SEQ ID NO: 1252 - DNA, 15 bp, Homo sapiens
aggaggctgaggcaa

SEQ ID NO: 1253 - DNA, 15 bp, Homo sapiens
caggaggctgaggca

SEQ ID NO: 1254 - DNA, 15 bp, Homo sapiens
ccaggaggctgaggc

SEQ ID NO: 1255 - DNA, 15 bp, Homo sapiens
cccaggaggctgagg

SEQ ID NO: 1256 - DNA, 15 bp, Homo sapiens
acccaggaggctgag

SEQ ID NO: 1257 - DNA, 15 bp, Homo sapiens
tacccaggaggctga

SEQ ID NO: 1258 - DNA, 15 bp, Homo sapiens
ctacccaggaggctg

SEQ ID NO: 1259 - DNA, 15 bp, Homo sapiens
gctacccaggaggct

SEQ ID NO: 1260 - DNA, 15 bp, Homo sapiens
agctacccaggaggc

SEQ ID NO: 1261 - DNA, 15 bp, Homo sapiens
cagctacccaggagg

SEQ ID NO: 1262 - DNA, 15 bp, Homo sapiens
ccagctacccaggag

SEQ ID NO: 1263 - DNA, 15 bp, Homo sapiens
cccagctacccagga

SEQ ID NO: 1264 - DNA, 15 bp, Homo sapiens
tcccagctacccagg

SEQ ID NO: 1265 - DNA, 15 bp, Homo sapiens
atcccagctacccag

SEQ ID NO: 1266 - DNA, 15 bp, Homo sapiens
aatcccagctaccca

SEQ ID NO: 1267 - DNA, 15 bp, Homo sapiens
taatcccagctaccc

SEQ ID NO: 1268 - DNA, 15 bp, Homo sapiens
gtaatcccagctacc

SEQ ID NO: 1269 - DNA, 15 bp, Homo sapiens
tgtaatcccagctac

SEQ ID NO: 1270 - DNA, 15 bp, Homo sapiens
ctgtaatcccagcta

SEQ ID NO: 1271 - DNA, 15 bp, Homo sapiens
cctgtaatcccagct

SEQ ID NO: 1272 - DNA, 15 bp, Homo sapiens
tgcctgtaatcccag

SEQ ID NO: 1273 - DNA, 15 bp, Homo sapiens
gtgcctgtaatccca

SEQ ID NO: 1274 - DNA, 15 bp, Homo sapiens
cgtgcctgtaatccc

SEQ ID NO: 1275 - DNA, 15 bp, Homo sapiens
gcgtgcctgtaatcc

SEQ ID NO: 1276 - DNA, 15 bp, Homo sapiens
cgcgtgcctgtaatc

SEQ ID NO: 1277 - DNA, 15 bp, Homo sapiens
gcgcgtgcctgtaat

SEQ ID NO: 1278 - DNA, 15 bp, Homo sapiens
agcgcgtgcctgtaa

SEQ ID NO: 1279 - DNA, 15 bp, Homo sapiens
cagcgcgtgcctgta

SEQ ID NO: 1280 - DNA, 15 bp, Homo sapiens
gcagcgcgtgcctgt

SEQ ID NO: 1281 - DNA, 15 bp, Homo sapiens
ggcagcgcgtgcctg

SEQ ID NO: 1282 - DNA, 15 bp, Homo sapiens
tggcagcgcgtgcct

SEQ ID NO: 1283 - DNA, 15 bp, Homo sapiens
gtggcagcgcgtgcc

SEQ ID NO: 1284 - DNA, 15 bp, Homo sapiens
tgtggcagcgcgtgc

SEQ ID NO: 1285 - DNA, 15 bp, Homo sapiens
gtgtggcagcgcgtg

SEQ ID NO: 1286 - DNA, 15 bp, Homo sapiens
ggtgtggcagcgcgt

SEQ ID NO: 1287 - DNA, 15 bp, Homo sapiens
gggtgtggcagcgcg

SEQ ID NO: 1288 - DNA, 15 bp, Homo sapiens
tgggtgtggcagcgc

SEQ ID NO: 1289 - DNA, 15 bp, Homo sapiens
ctgggtgtggcagcg

SEQ ID NO: 1290 - DNA, 15 bp, Homo sapiens
cctgggtgtggcagc

SEQ ID NO: 1291 - DNA, 15 bp, Homo sapiens
acctgggtgtggcag

SEQ ID NO: 1292 - DNA, 15 bp, Homo sapiens
tacctgggtgtggca

SEQ ID NO: 1293 - DNA, 15 bp, Homo sapiens
ttacctgggtgtggc

SEQ ID NO: 1294 - DNA, 15 bp, Homo sapiens
attacctgggtgtgg

SEQ ID NO: 1295 - DNA, 15 bp, Homo sapiens
aattacctgggtgtg

SEQ ID NO: 1296 - DNA, 15 bp, Homo sapiens
aaattacctgggtgt

SEQ ID NO: 1297 - DNA, 15 bp, Homo sapiens
taaattacctgggtg

SEQ ID NO: 1298 - DNA, 15 bp, Homo sapiens
ataaattacctgggt

SEQ ID NO: 1299 - DNA, 15 bp, Homo sapiens
aataaattacctggg

SEQ ID NO: 1300 - DNA, 15 bp, Homo sapiens
aaataaattacctgg

SEQ ID NO: 1301 - DNA, 15 bp, Homo sapiens
taaataaattacctg

SEQ ID NO: 1302 - DNA, 15 bp, Homo sapiens
ataaataaattacct

SEQ ID NO: 1303 - DNA, 15 bp, Homo sapiens
aataaataaattacc

SEQ ID NO: 1304 - DNA, 15 bp, Homo sapiens
aaataaataaattac

SEQ ID NO: 1305 - DNA, 15 bp, Homo sapiens
aaaataaataaatta

SEQ ID NO: 1306 - DNA, 15 bp, Homo sapiens
aaaaataaataaatt

SEQ ID NO: 1307 - DNA, 15 bp, Homo sapiens
aaaaaataaataaat

SEQ ID NO: 1308 - DNA, 15 bp, Homo sapiens
aaaaaaataaataaa

SEQ ID NO: 1309 - DNA, 15 bp, Homo sapiens
aaaaaaaataaataa

SEQ ID NO: 1310 - DNA, 15 bp, Homo sapiens
aaaaaaaaataaata

SEQ ID NO: 1311 - DNA, 15 bp, Homo sapiens
aaaaaaaaaataaat

SEQ ID NO: 1312 - DNA, 15 bp, Homo sapiens
caaaaaaaaaataaa

SEQ ID NO: 1313 - DNA, 15 bp, Homo sapiens
tcaaaaaaaaaataa

SEQ ID NO: 1314 - DNA, 15 bp, Homo sapiens
ctcaaaaaaaaaata

SEQ ID NO: 1315 - DNA, 15 bp, Homo sapiens
tctcaaaaaaaaaat

SEQ ID NO: 1316 - DNA, 15 bp, Homo sapiens
gtctcaaaaaaaaaa

SEQ ID NO: 1317 - DNA, 15 bp, Homo sapiens
tgtctcaaaaaaaaa

SEQ ID NO: 1318 - DNA, 15 bp, Homo sapiens
ctgtctcaaaaaaaa

SEQ ID NO: 1319 - DNA, 15 bp, Homo sapiens
tctgtctcaaaaaaa

SEQ ID NO: 1320 - DNA, 15 bp, Homo sapiens
ctctgtctcaaaaaa

SEQ ID NO: 1321 - DNA, 15 bp, Homo sapiens
actctgtctcaaaaa

SEQ ID NO: 1322 - DNA, 15 bp, Homo sapiens
gactctgtctcaaaa

SEQ ID NO: 1323 - DNA, 15 bp, Homo sapiens
agactctgtctcaaa

SEQ ID NO: 1324 - DNA, 15 bp, Homo sapiens
gagactctgtctcaa

SEQ ID NO: 1325 - DNA, 15 bp, Homo sapiens
cgagactctgtctca

SEQ ID NO: 1326 - DNA, 15 bp, Homo sapiens
gcgagactctgtctc

SEQ ID NO: 1327 - DNA, 15 bp, Homo sapiens
tgcgagactctgtct

SEQ ID NO: 1328 - DNA, 15 bp, Homo sapiens
gtgcgagactctgtc

SEQ ID NO: 1329 - DNA, 15 bp, Homo sapiens
agtgcgagactctgt

SEQ ID NO: 1330 - DNA, 15 bp, Homo sapiens
cagtgcgagactctg

SEQ ID NO: 1331 - DNA, 15 bp, Homo sapiens
acagtgcgagactct

SEQ ID NO: 1332 - DNA, 15 bp, Homo sapiens
aacagtgcgagactc

SEQ ID NO: 1333 - DNA, 15 bp, Homo sapiens
caacagtgcgagact

SEQ ID NO: 1334 - DNA, 15 bp, Homo sapiens
gcaacagtgcgagac

SEQ ID NO: 1335 - DNA, 15 bp, Homo sapiens
ggcaacagtgcgaga

SEQ ID NO: 1336 - DNA, 15 bp, Homo sapiens
gggcaacagtgcgag

SEQ ID NO: 1337 - DNA, 15 bp, Homo sapiens
tgggcaacagtgcga

SEQ ID NO: 1338 - DNA, 15 bp, Homo sapiens
ctgggcaacagtgcg

SEQ ID NO: 1339 - DNA, 15 bp, Homo sapiens
cctgggcaacagtgc

SEQ ID NO: 1340 - DNA, 15 bp, Homo sapiens
gcctgggcaacagtg

SEQ ID NO: 1341 - DNA, 15 bp, Homo sapiens
agcctgggcaacagt

SEQ ID NO: 1342 - DNA, 15 bp, Homo sapiens
cagcctgggcaacag

SEQ ID NO: 1343 - DNA, 15 bp, Homo sapiens
ccagcctgggcaaca

SEQ ID NO: 1344 - DNA, 15 bp, Homo sapiens
tccagcctgggcaac

SEQ ID NO: 1345 - DNA, 15 bp, Homo sapiens
gtccagcctgggcaa

SEQ ID NO: 1346 - DNA, 15 bp, Homo sapiens
agtccagcctgggca

SEQ ID NO: 1347 - DNA, 15 bp, Homo sapiens
cagtccagcctgggc

SEQ ID NO: 1348 - DNA, 15 bp, Homo sapiens
gcagtccagcctggg

SEQ ID NO: 1349 - DNA, 15 bp, Homo sapiens
tgcagtccagcctgg

SEQ ID NO: 1350 - DNA, 15 bp, Homo sapiens
ctgcagtccagcctg

SEQ ID NO: 1351 - DNA, 15 bp, Homo sapiens
actgcagtccagcct

SEQ ID NO: 1352 - DNA, 15 bp, Homo sapiens
cactgcagtccagcc

SEQ ID NO: 1353 - DNA, 15 bp, Homo sapiens
ccactgcagtccagc

SEQ ID NO: 1354 - DNA, 15 bp, Homo sapiens
gccactgcagtccag

SEQ ID NO: 1355 - DNA, 15 bp, Homo sapiens
cgccactgcagtcca

SEQ ID NO: 1356 - DNA, 15 bp, Homo sapiens
acgccactgcagtcc

SEQ ID NO: 1357 - DNA, 15 bp, Homo sapiens
cacgccactgcagtc

SEQ ID NO: 1358 - DNA, 15 bp, Homo sapiens
tcacgccactgcagt

SEQ ID NO: 1359 - DNA, 15 bp, Homo sapiens
atcacgccactgcag

SEQ ID NO: 1360 - DNA, 15 bp, Homo sapiens
gatcacgccactgca

SEQ ID NO: 1361 - DNA, 15 bp, Homo sapiens
agatcacgccactgc

SEQ ID NO: 1362 - DNA, 15 bp, Homo sapiens
gagatcacgccactg

SEQ ID NO: 1363 - DNA, 15 bp, Homo sapiens
agagatcacgccact

SEQ ID NO: 1364 - DNA, 15 bp, Homo sapiens
cagagatcacgccac

SEQ ID NO: 1365 - DNA, 15 bp, Homo sapiens
gcagagatcacgcca

SEQ ID NO: 1366 - DNA, 15 bp, Homo sapiens
agcagagatcacgcc

SEQ ID NO: 1367 - DNA, 15 bp, Homo sapiens
gagcagagatcacgc

SEQ ID NO: 1368 - DNA, 15 bp, Homo sapiens
tgagcagagatcacg

SEQ ID NO: 1369 - DNA, 15 bp, Homo sapiens
gtgagcagagatcac

SEQ ID NO: 1370 - DNA, 15 bp, Homo sapiens
agtgagcagagatca

SEQ ID NO: 1371 - DNA, 15 bp, Homo sapiens
cagtgagcagagatc

SEQ ID NO: 1372 - DNA, 15 bp, Homo sapiens
gcagtgagcagagat

SEQ ID NO: 1373 - DNA, 15 bp, Homo sapiens
tgcagtgagcagaga

SEQ ID NO: 1374 - DNA, 15 bp, Homo sapiens
ttgcagtgagcagag

SEQ ID NO: 1375 - DNA, 15 bp, Homo sapiens
gttgcagtgagcaga

SEQ ID NO: 1376 - DNA, 15 bp, Homo sapiens
ggttgcagtgagcag

SEQ ID NO: 1377 - DNA, 15 bp, Homo sapiens
aggttgcagtgagca

SEQ ID NO: 1378 - DNA, 15 bp, Homo sapiens
gaggttgcagtgagc

SEQ ID NO: 1379 - DNA, 15 bp, Homo sapiens
ggaggttgcagtgag

SEQ ID NO: 1380 - DNA, 15 bp, Homo sapiens
cggaggttgcagtga

SEQ ID NO: 1381 - DNA, 15 bp, Homo sapiens
gcggaggttgcagtg

SEQ ID NO: 1382 - DNA, 15 bp, Homo sapiens
ggcggaggttgcagt

SEQ ID NO: 1383 - DNA, 15 bp, Homo sapiens
aggcggaggttgcag

SEQ ID NO: 1384 - DNA, 15 bp, Homo sapiens
gaggcggaggttgca

SEQ ID NO: 1385 - DNA, 15 bp, Homo sapiens
ggaggcggaggttgc

SEQ ID NO: 1386 - DNA, 15 bp, Homo sapiens
gggaggcggaggttg

SEQ ID NO: 1387 - DNA, 15 bp, Homo sapiens
cgggaggcggaggtt

SEQ ID NO: 1388 - DNA, 15 bp, Homo sapiens
ccgggaggcggaggt

SEQ ID NO: 1389 - DNA, 15 bp, Homo sapiens
cccgggaggcggagg

SEQ ID NO: 1390 - DNA, 15 bp, Homo sapiens
acccgggaggcggag

SEQ ID NO: 1391 - DNA, 15 bp, Homo sapiens
aacccgggaggcgga

SEQ ID NO: 1392 - DNA, 15 bp, Homo sapiens
gaacccgggaggcgg

SEQ ID NO: 1393 - DNA, 15 bp, Homo sapiens
tgaacccgggaggcg

SEQ ID NO: 1394 - DNA, 15 bp, Homo sapiens
ttgaacccgggaggc

SEQ ID NO: 1395 - DNA, 15 bp, Homo sapiens
cttgaacccgggagg

SEQ ID NO: 1396 - DNA, 15 bp, Homo sapiens
gcttgaacccgggag

SEQ ID NO: 1397 - DNA, 15 bp, Homo sapiens
cgcttgaacccggga

SEQ ID NO: 1398 - DNA, 15 bp, Homo sapiens
tcgcttgaacccggg

SEQ ID NO: 1399 - DNA, 15 bp, Homo sapiens
atcgcttgaacccgg

SEQ ID NO: 1400 - DNA, 15 bp, Homo sapiens
aatcgcttgaacccg

SEQ ID NO: 1401 - DNA, 15 bp, Homo sapiens
gaatcgcttgaaccc

SEQ ID NO: 1402 - DNA, 15 bp, Homo sapiens
agaatcgcttgaacc

SEQ ID NO: 1403 - DNA, 15 bp, Homo sapiens
gagaatcgcttgaac

SEQ ID NO: 1404 - DNA, 15 bp, Homo sapiens
ggagaatcgcttgaa

SEQ ID NO: 1405 - DNA, 15 bp, Homo sapiens
tggagaatcgcttga

SEQ ID NO: 1406 - DNA, 15 bp, Homo sapiens
ctggagaatcgcttg

SEQ ID NO: 1407 - DNA, 15 bp, Homo sapiens
gctggagaatcgctt

SEQ ID NO: 1408 - DNA, 15 bp, Homo sapiens
ggctggagaatcgct

SEQ ID NO: 1409 - DNA, 15 bp, Homo sapiens
aggctggagaatcgc

SEQ ID NO: 1410 - DNA, 15 bp, Homo sapiens
gaggctggagaatcg

SEQ ID NO: 1411 - DNA, 15 bp, Homo sapiens
tgaggctggagaatc

SEQ ID NO: 1412 - DNA, 15 bp, Homo sapiens
ctgaggctggagaat

SEQ ID NO: 1413 - DNA, 15 bp, Homo sapiens
gctgaggctggagaa

SEQ ID NO: 1414 - DNA, 15 bp, Homo sapiens
agctgaggctggaga

SEQ ID NO: 1415 - DNA, 15 bp, Homo sapiens
aagctgaggctggag

SEQ ID NO: 1416 - DNA, 15 bp, Homo sapiens
gaagctgaggctgga

SEQ ID NO: 1417 - DNA, 15 bp, Homo sapiens
ggaagctgaggctgg

SEQ ID NO: 1418 - DNA, 15 bp, Homo sapiens
aggaagctgaggctg

SEQ ID NO: 1419 - DNA, 15 bp, Homo sapiens
caggaagctgaggct

SEQ ID NO: 1420 - DNA, 15 bp, Homo sapiens
tcaggaagctgaggc

SEQ ID NO: 1421 - DNA, 15 bp, Homo sapiens
ctcaggaagctgagg

SEQ ID NO: 1422 - DNA, 15 bp, Homo sapiens
actcaggaagctgag

SEQ ID NO: 1423 - DNA, 15 bp, Homo sapiens
tactcaggaagctga

SEQ ID NO: 1424 - DNA, 15 bp, Homo sapiens
ctactcaggaagctg

SEQ ID NO: 1425 - DNA, 15 bp, Homo sapiens
tctactcaggaagct

SEQ ID NO: 1426 - DNA, 15 bp, Homo sapiens
atctactcaggaagc

SEQ ID NO: 1427 - DNA, 15 bp, Homo sapiens
catctactcaggaag

SEQ ID NO: 1428 - DNA, 15 bp, Homo sapiens
ccatctactcaggaa

SEQ ID NO: 1429 - DNA, 15 bp, Homo sapiens
cccatctactcagga

SEQ ID NO: 1430 - DNA, 15 bp, Homo sapiens
tcccatctactcagg

SEQ ID NO: 1431 - DNA, 15 bp, Homo sapiens
atcccatctactcag

SEQ ID NO: 1432 - DNA, 15 bp, Homo sapiens
aatcccatctactca

SEQ ID NO: 1433 - DNA, 15 bp, Homo sapiens
taatcccatctactc

SEQ ID NO: 1434 - DNA, 15 bp, Homo sapiens
gtaatcccatctact

SEQ ID NO: 1435 - DNA, 15 bp, Homo sapiens
tgtaatcccatctac

SEQ ID NO: 1436 - DNA, 15 bp, Homo sapiens
ctgtaatcccatcta

SEQ ID NO: 1437 - DNA, 15 bp, Homo sapiens
cctgtaatcccatct

SEQ ID NO: 1438 - DNA, 15 bp, Homo sapiens
gcctgtaatcccatc

SEQ ID NO: 1439 - DNA, 15 bp, Homo sapiens
cgcctgtaatcccat

SEQ ID NO: 1440 - DNA, 15 bp, Homo sapiens
gcgcctgtaatccca

SEQ ID NO: 1441 - DNA, 15 bp, Homo sapiens
ggcgcctgtaatccc

SEQ ID NO: 1442 - DNA, 15 bp, Homo sapiens
aggcgcctgtaatcc

SEQ ID NO: 1443 - DNA, 15 bp, Homo sapiens
caggcgcctgtaatc

SEQ ID NO: 1444 - DNA, 15 bp, Homo sapiens
gcaggcgcctgtaat

SEQ ID NO: 1445 - DNA, 15 bp, Homo sapiens
ggcaggcgcctgtaa

SEQ ID NO: 1446 - DNA, 15 bp, Homo sapiens
tggcaggcgcctgta

SEQ ID NO: 1447 - DNA, 15 bp, Homo sapiens
gtggcaggcgcctgt

SEQ ID NO: 1448 - DNA, 15 bp, Homo sapiens
ggtggcaggcgcctg

SEQ ID NO: 1449 - DNA, 15 bp, Homo sapiens
tggtggcaggcgcct

SEQ ID NO: 1450 - DNA, 15 bp, Homo sapiens
gtggtggcaggcgcc

SEQ ID NO: 1451 - DNA, 15 bp, Homo sapiens
cgtggtggcaggcgc

SEQ ID NO: 1452 - DNA, 15 bp, Homo sapiens
gcgtggtggcaggcg

SEQ ID NO: 1453 - DNA, 15 bp, Homo sapiens
ggcgtggtggcaggc

SEQ ID NO: 1454 - DNA, 15 bp, Homo sapiens
gggcgtggtggcagg

SEQ ID NO: 1455 - DNA, 15 bp, Homo sapiens
tgggcgtggtggcag

SEQ ID NO: 1456 - DNA, 15 bp, Homo sapiens
ctgggcgtggtggca

SEQ ID NO: 1457 - DNA, 15 bp, Homo sapiens
aaattagctgggcgt

SEQ ID NO: 1458 - DNA, 15 bp, Homo sapiens
aaaattagctgggcg

SEQ ID NO: 1459 - DNA, 15 bp, Homo sapiens
aaaaaattagctggg

SEQ ID NO: 1460 - DNA, 15 bp, Homo sapiens
caaaaaattagctgg

SEQ ID NO: 1461 - DNA, 15 bp, Homo sapiens
acaaaaaattagctg

SEQ ID NO: 1462 - DNA, 15 bp, Homo sapiens
tacaaaaaattagct

SEQ ID NO: 1463 - DNA, 15 bp, Homo sapiens
atacaaaaaattagc

SEQ ID NO: 1464 - DNA, 15 bp, Homo sapiens
aatacaaaaaattag

SEQ ID NO: 1465 - DNA, 15 bp, Homo sapiens
gaatacaaaaaatta

SEQ ID NO: 1466 - DNA, 15 bp, Homo sapiens
agaatacaaaaaatt

SEQ ID NO: 1467 - DNA, 15 bp, Homo sapiens
aagaatacaaaaaat

SEQ ID NO: 1468 - DNA, 15 bp, Homo sapiens
taagaatacaaaaaa

SEQ ID NO: 1469 - DNA, 15 bp, Homo sapiens
ctaagaatacaaaaa

SEQ ID NO: 1470 - DNA, 15 bp, Homo sapiens
actaagaatacaaaa

SEQ ID NO: 1471 - DNA, 15 bp, Homo sapiens
tactaagaatacaaa

SEQ ID NO: 1472 - DNA, 15 bp, Homo sapiens
ctactaagaatacaa

SEQ ID NO: 1473 - DNA, 15 bp, Homo sapiens
tctactaagaataca

SEQ ID NO: 1474 - DNA, 15 bp, Homo sapiens
ctctactaagaatac

SEQ ID NO: 1475 - DNA, 15 bp, Homo sapiens
tctctactaagaata

SEQ ID NO: 1476 - DNA, 15 bp, Homo sapiens
atctctactaagaat

SEQ ID NO: 1477 - DNA, 15 bp, Homo sapiens
catctctactaagaa

SEQ ID NO: 1478 - DNA, 15 bp, Homo sapiens
ccatctctactaaga

SEQ ID NO: 1479 - DNA, 15 bp, Homo sapiens
cccatctctactaag

SEQ ID NO: 1480 - DNA, 15 bp, Homo sapiens
ccccatctctactaa

SEQ ID NO: 1481 - DNA, 15 bp, Homo sapiens
accccatctctacta

SEQ ID NO: 1482 - DNA, 15 bp, Homo sapiens
aaccccatctctact

SEQ ID NO: 1483 - DNA, 15 bp, Homo sapiens
aaaccccatctctac

SEQ ID NO: 1484 - DNA, 15 bp, Homo sapiens
gaaaccccatctcta

SEQ ID NO: 1485 - DNA, 15 bp, Homo sapiens
tgaaaccccatctct

SEQ ID NO: 1486 - DNA, 15 bp, Homo sapiens
gtgaaaccccatctc

SEQ ID NO: 1487 - DNA, 15 bp, Homo sapiens
ggtgaaaccccatct

SEQ ID NO: 1488 - DNA, 15 bp, Homo sapiens
tggtgaaaccccatc

SEQ ID NO: 1489 - DNA, 15 bp, Homo sapiens
atggtgaaaccccat

SEQ ID NO: 1490 - DNA, 15 bp, Homo sapiens
catggtgaaacccca

SEQ ID NO: 1491 - DNA, 15 bp, Homo sapiens
gccaacatggtgaaa

SEQ ID NO: 1492 - DNA, 15 bp, Homo sapiens
ggccaacatggtgaa

SEQ ID NO: 1493 - DNA, 15 bp, Homo sapiens
tggccaacatggtga

SEQ ID NO: 1494 - DNA, 15 bp, Homo sapiens
ctggccaacatggtg

SEQ ID NO: 1495 - DNA, 15 bp, Homo sapiens
cctggccaacatggt

SEQ ID NO: 1496 - DNA, 15 bp, Homo sapiens
gcctggccaacatgg

SEQ ID NO: 1497 - DNA, 15 bp, Homo sapiens
agcctggccaacatg

SEQ ID NO: 1498 - DNA, 15 bp, Homo sapiens
cagcctggccaacat

SEQ ID NO: 1499 - DNA, 15 bp, Homo sapiens
ccagcctggccaaca

SEQ ID NO: 1500 - DNA, 15 bp, Homo sapiens
accagcctggccaac

SEQ ID NO: 1501 - DNA, 15 bp, Homo sapiens
gaccagcctggccaa

SEQ ID NO: 1502 - DNA, 15 bp, Homo sapiens
agaccagcctggcca

SEQ ID NO: 1503 - DNA, 15 bp, Homo sapiens
gagaccagcctggcc

SEQ ID NO: 1504 - DNA, 15 bp, Homo sapiens
ggagaccagcctggc

SEQ ID NO: 1505 - DNA, 15 bp, Homo sapiens
tggagaccagcctgg

SEQ ID NO: 1506 - DNA, 15 bp, Homo sapiens
atggagaccagcctg

SEQ ID NO: 1507 - DNA, 15 bp, Homo sapiens
gatggagaccagcct

SEQ ID NO: 1508 - DNA, 15 bp, Homo sapiens
agatggagaccagcc

SEQ ID NO: 1509 - DNA, 15 bp, Homo sapiens
gagatggagaccagc

SEQ ID NO: 1510 - DNA, 15 bp, Homo sapiens
ggagatggagaccag

SEQ ID NO: 1511 - DNA, 15 bp, Homo sapiens
aggagatggagacca

SEQ ID NO: 1512 - DNA, 15 bp, Homo sapiens
caggagatggagacc

SEQ ID NO: 1513 - DNA, 15 bp, Homo sapiens
tcaggagatggagac

SEQ ID NO: 1514 - DNA, 15 bp, Homo sapiens
gtcaggagatggaga

SEQ ID NO: 1515 - DNA, 15 bp, Homo sapiens
ggtcaggagatggag

SEQ ID NO: 1516 - DNA, 15 bp, Homo sapiens
aggtcaggagatgga

SEQ ID NO: 1517 - DNA, 15 bp, Homo sapiens
gaggtcaggagatgg

SEQ ID NO: 1518 - DNA, 15 bp, Homo sapiens
cgaggtcaggagatg

SEQ ID NO: 1519 - DNA, 15 bp, Homo sapiens
acgaggtcaggagat

SEQ ID NO: 1520 - DNA, 15 bp, Homo sapiens
cacgaggtcaggaga

SEQ ID NO: 1521 - DNA, 15 bp, Homo sapiens
tcacgaggtcaggag

SEQ ID NO: 1522 - DNA, 15 bp, Homo sapiens
atcacgaggtcagga

SEQ ID NO: 1523 - DNA, 15 bp, Homo sapiens
aatcacgaggtcagg

SEQ ID NO: 1524 - DNA, 15 bp, Homo sapiens
gaatcacgaggtcag

SEQ ID NO: 1525 - DNA, 15 bp, Homo sapiens
tgaatcacgaggtca

SEQ ID NO: 1526 - DNA, 15 bp, Homo sapiens
gtgaatcacgaggtc

SEQ ID NO: 1527 - DNA, 15 bp, Homo sapiens
ggtgaatcacgaggt

SEQ ID NO: 1528 - DNA, 15 bp, Homo sapiens
gggtgaatcacgagg

SEQ ID NO: 1529 - DNA, 15 bp, Homo sapiens
cgggtgaatcacgag

SEQ ID NO: 1530 - DNA, 15 bp, Homo sapiens
gcgggtgaatcacga

SEQ ID NO: 1531 - DNA, 15 bp, Homo sapiens
ggcgggtgaatcacg

SEQ ID NO: 1532 - DNA, 15 bp, Homo sapiens
aggcgggtgaatcac

SEQ ID NO: 1533 - DNA, 15 bp, Homo sapiens
gaggcgggtgaatca

SEQ ID NO: 1534 - DNA, 15 bp, Homo sapiens
cgaggcgggtgaatc

SEQ ID NO: 1535 - DNA, 15 bp, Homo sapiens
ccgaggcgggtgaat

SEQ ID NO: 1536 - DNA, 15 bp, Homo sapiens
gccgaggcgggtgaa

SEQ ID NO: 1537 - DNA, 15 bp, Homo sapiens
ggccgaggcgggtga

SEQ ID NO: 1538 - DNA, 15 bp, Homo sapiens
aggccgaggcgggtg

SEQ ID NO: 1539 - DNA, 15 bp, Homo sapiens
gaggccgaggcgggt

SEQ ID NO: 1540 - DNA, 15 bp, Homo sapiens
ggaggccgaggcggg

SEQ ID NO: 1541 - DNA, 15 bp, Homo sapiens
gggaggccgaggcgg

SEQ ID NO: 1542 - DNA, 15 bp, Homo sapiens
tgggaggccgaggcg

SEQ ID NO: 1543 - DNA, 15 bp, Homo sapiens
ttgggaggccgaggc

SEQ ID NO: 1544 - DNA, 15 bp, Homo sapiens
tttgggaggccgagg

SEQ ID NO: 1545 - DNA, 15 bp, Homo sapiens
ctttgggaggccgag

SEQ ID NO: 1546 - DNA, 15 bp, Homo sapiens
actttgggaggccga

SEQ ID NO: 1547 - DNA, 15 bp, Homo sapiens
cactttgggaggccg

SEQ ID NO: 1548 - DNA, 15 bp, Homo sapiens
actcacgcctgtaat

SEQ ID NO: 1549 - DNA, 15 bp, Homo sapiens
gactcacgcctgtaa

SEQ ID NO: 1550 - DNA, 15 bp, Homo sapiens
tgactcacgcctgta

SEQ ID NO: 1551 - DNA, 15 bp, Homo sapiens
gtgactcacgcctgt

SEQ ID NO: 1552 - DNA, 15 bp, Homo sapiens
tgtgactcacgcctg

SEQ ID NO: 1553 - DNA, 15 bp, Homo sapiens
ctgtgactcacgcct

SEQ ID NO: 1554 - DNA, 15 bp, Homo sapiens
gctgtgactcacgcc

SEQ ID NO: 1555 - DNA, 15 bp, Homo sapiens
ggctgtgactcacgc

SEQ ID NO: 1556 - DNA, 15 bp, Homo sapiens
gggctgtgactcacg

SEQ ID NO: 1557 - DNA, 15 bp, Homo sapiens
ggggctgtgactcac

SEQ ID NO: 1558 - DNA, 15 bp, Homo sapiens
gggggctgtgactca

SEQ ID NO: 1559 - DNA, 15 bp, Homo sapiens
cgggggctgtgactc

SEQ ID NO: 1560 - DNA, 15 bp, Homo sapiens
ccgggggctgtgact

SEQ ID NO: 1561 - DNA, 15 bp, Homo sapiens
gccgggggctgtgac

SEQ ID NO: 1562 - DNA, 15 bp, Homo sapiens
ggccgggggctgtga

SEQ ID NO: 1563 - DNA, 15 bp, Homo sapiens
tggccgggggctgtg

SEQ ID NO: 1564 - DNA, 15 bp, Homo sapiens
atggccgggggctgt

SEQ ID NO: 1565 - DNA, 15 bp, Homo sapiens
tatggccgggggctg

SEQ ID NO: 1566 - DNA, 15 bp, Homo sapiens
ttatggccgggggct

SEQ ID NO: 1567 - DNA, 15 bp, Homo sapiens
attatggccgggggc

SEQ ID NO: 1568 - DNA, 15 bp, Homo sapiens
aattatggccggggg

SEQ ID NO: 1569 - DNA, 15 bp, Homo sapiens
aaattatggccgggg

SEQ ID NO: 1570 - DNA, 15 bp, Homo sapiens
taaattatggccggg

SEQ ID NO: 1571 - DNA, 15 bp, Homo sapiens
ctaaattatggccgg

SEQ ID NO: 1572 - DNA, 15 bp, Homo sapiens
gctaaattatggccg

SEQ ID NO: 1573 - DNA, 15 bp, Homo sapiens
tgctaaattatggcc

SEQ ID NO: 1574 - DNA, 15 bp, Homo sapiens
gtgctaaattatggc

SEQ ID NO: 1575 - DNA, 15 bp, Homo sapiens
agtgctaaattatgg

SEQ ID NO: 1576 - DNA, 15 bp, Homo sapiens
aagtgctaaattatg

SEQ ID NO: 1577 - DNA, 15 bp, Homo sapiens
aaagtgctaaattat

SEQ ID NO: 1578 - DNA, 15 bp, Homo sapiens
taaagtgctaaatta

SEQ ID NO: 1579 - DNA, 15 bp, Homo sapiens
ttaaagtgctaaatt

SEQ ID NO: 1580 - DNA, 15 bp, Homo sapiens
tttaaagtgctaaat

SEQ ID NO: 1581 - DNA, 15 bp, Homo sapiens
ttttaaagtgctaaa

SEQ ID NO: 1582 - DNA, 15 bp, Homo sapiens
tttttaaagtgctaa

SEQ ID NO: 1583 - DNA, 15 bp, Homo sapiens
ttttttaaagtgcta

SEQ ID NO: 1584 - DNA, 15 bp, Homo sapiens
attttttaaagtgct

SEQ ID NO: 1585 - DNA, 15 bp, Homo sapiens
tattttttaaagtgc

SEQ ID NO: 1586 - DNA, 15 bp, Homo sapiens
ttattttttaaagtg

SEQ ID NO: 1587 - DNA, 15 bp, Homo sapiens
attattttttaaagt

SEQ ID NO: 1588 - DNA, 15 bp, Homo sapiens
tattattttttaaag

SEQ ID NO: 1589 - DNA, 15 bp, Homo sapiens
ctattattttttaaa

SEQ ID NO: 1590 - DNA, 15 bp, Homo sapiens
gctattattttttaa

SEQ ID NO: 1591 - DNA, 15 bp, Homo sapiens
ggctattatttttta

SEQ ID NO: 1592 - DNA, 15 bp, Homo sapiens
tggctattatttttt

SEQ ID NO: 1593 - DNA, 15 bp, Homo sapiens
atggctattattttt

SEQ ID NO: 1594 - DNA, 15 bp, Homo sapiens
catggctattatttt

SEQ ID NO: 1595 - DNA, 15 bp, Homo sapiens
acatggctattattt

SEQ ID NO: 1596 - DNA, 15 bp, Homo sapiens
aacatggctattatt

SEQ ID NO: 1597 - DNA, 15 bp, Homo sapiens
caacatggctattat

SEQ ID NO: 1598 - DNA, 15 bp, Homo sapiens
ccaacatggctatta

SEQ ID NO: 1599 - DNA, 15 bp, Homo sapiens
cccaacatggctatt

SEQ ID NO: 1600 - DNA, 15 bp, Homo sapiens
gcccaacatggctat

SEQ ID NO: 1601 - DNA, 15 bp, Homo sapiens
ggcccaacatggcta

SEQ ID NO: 1602 - DNA, 15 bp, Homo sapiens
tggcccaacatggct

SEQ ID NO: 1603 - DNA, 15 bp, Homo sapiens
ctggcccaacatggc

SEQ ID NO: 1604 - DNA, 15 bp, Homo sapiens
cctggcccaacatgg

SEQ ID NO: 1605 - DNA, 15 bp, Homo sapiens
gcctggcccaacatg

SEQ ID NO: 1606 - DNA, 15 bp, Homo sapiens
cgcctggcccaacat

SEQ ID NO: 1607 - DNA, 15 bp, Homo sapiens
acgcctggcccaaca

SEQ ID NO: 1608 - DNA, 15 bp, Homo sapiens
cacgcctggcccaac

SEQ ID NO: 1609 - DNA, 15 bp, Homo sapiens
ccacgcctggcccaa

SEQ ID NO: 1610 - DNA, 15 bp, Homo sapiens
accacgcctggccca

SEQ ID NO: 1611 - DNA, 15 bp, Homo sapiens
caccacgcctggccc

SEQ ID NO: 1612 - DNA, 15 bp, Homo sapiens
ccaccacgcctggcc

SEQ ID NO: 1613 - DNA, 15 bp, Homo sapiens
gccaccacgcctggc

SEQ ID NO: 1614 - DNA, 15 bp, Homo sapiens
agccaccacgcctgg

SEQ ID NO: 1615 - DNA, 15 bp, Homo sapiens
gagccaccacgcctg

SEQ ID NO: 1616 - DNA, 15 bp, Homo sapiens
tgagccaccacgcct

SEQ ID NO: 1617 - DNA, 15 bp, Homo sapiens
atgagccaccacgcc

SEQ ID NO: 1618 - DNA, 15 bp, Homo sapiens
catgagccaccacgc

SEQ ID NO: 1619 - DNA, 15 bp, Homo sapiens
gcatgagccaccacg

SEQ ID NO: 1620 - DNA, 15 bp, Homo sapiens
ggcatgagccaccac

SEQ ID NO: 1621 - DNA, 15 bp, Homo sapiens
agattacaggcatga

SEQ ID NO: 1622 - DNA, 15 bp, Homo sapiens
cagattacaggcatg

SEQ ID NO: 1623 - DNA, 15 bp, Homo sapiens
tcagattacaggcat

SEQ ID NO: 1624 - DNA, 15 bp, Homo sapiens
ctcagattacaggca

SEQ ID NO: 1625 - DNA, 15 bp, Homo sapiens
gctcagattacaggc

SEQ ID NO: 1626 - DNA, 15 bp, Homo sapiens
tgctcagattacagg

SEQ ID NO: 1627 - DNA, 15 bp, Homo sapiens
gtgctcagattacag

SEQ ID NO: 1628 - DNA, 15 bp, Homo sapiens
agtgctcagattaca

SEQ ID NO: 1629 - DNA, 15 bp, Homo sapiens
aagtgctcagattac

SEQ ID NO: 1630 - DNA, 15 bp, Homo sapiens
aaagtgctcagatta

SEQ ID NO: 1631 - DNA, 15 bp, Homo sapiens
caaagtgctcagatt

SEQ ID NO: 1632 - DNA, 15 bp, Homo sapiens
ccaaagtgctcagat

SEQ ID NO: 1633 - DNA, 15 bp, Homo sapiens
cccaaagtgctcaga

SEQ ID NO: 1634 - DNA, 15 bp, Homo sapiens
tcccaaagtgctcag

SEQ ID NO: 1635 - DNA, 15 bp, Homo sapiens
ctcccaaagtgctca

SEQ ID NO: 1636 - DNA, 15 bp, Homo sapiens
tctcccaaagtgctc

SEQ ID NO: 1637 - DNA, 15 bp, Homo sapiens
gtctcccaaagtgct

SEQ ID NO: 1638 - DNA, 15 bp, Homo sapiens
ggtctcccaaagtgc

SEQ ID NO: 1639 - DNA, 15 bp, Homo sapiens
tggtctcccaaagtg

SEQ ID NO: 1640 - DNA, 15 bp, Homo sapiens
ttggtctcccaaagt

SEQ ID NO: 1641 - DNA, 15 bp, Homo sapiens
cttggtctcccaaag

SEQ ID NO: 1642 - DNA, 15 bp, Homo sapiens
ccttggtctcccaaa

SEQ ID NO: 1643 - DNA, 15 bp, Homo sapiens
gccttggtctcccaa

SEQ ID NO: 1644 - DNA, 15 bp, Homo sapiens
cgccttggtctccca

SEQ ID NO: 1645 - DNA, 15 bp, Homo sapiens
ccgccttggtctccc

SEQ ID NO: 1646 - DNA, 15 bp, Homo sapiens
cccgccttggtctcc

SEQ ID NO: 1647 - DNA, 15 bp, Homo sapiens
acccgccttggtctc

SEQ ID NO: 1648 - DNA, 15 bp, Homo sapiens
tacccgccttggtct

SEQ ID NO: 1649 - DNA, 15 bp, Homo sapiens
ctacccgccttggtc

SEQ ID NO: 1650 - DNA, 15 bp, Homo sapiens
tctacccgccttggt

SEQ ID NO: 1651 - DNA, 15 bp, Homo sapiens
atctacccgccttgg

SEQ ID NO: 1652 - DNA, 15 bp, Homo sapiens
gatctacccgccttg

SEQ ID NO: 1653 - DNA, 15 bp, Homo sapiens
ggatctacccgcctt

SEQ ID NO: 1654 - DNA, 15 bp, Homo sapiens
gggatctacccgcct

SEQ ID NO: 1655 - DNA, 15 bp, Homo sapiens
agggatctacccgcc

SEQ ID NO: 1656 - DNA, 15 bp, Homo sapiens
aagggatctacccgc

SEQ ID NO: 1657 - DNA, 15 bp, Homo sapiens
caagggatctacccg

SEQ ID NO: 1658 - DNA, 15 bp, Homo sapiens
acaagggatctaccc

SEQ ID NO: 1659 - DNA, 15 bp, Homo sapiens
cacaagggatctacc

SEQ ID NO: 1660 - DNA, 15 bp, Homo sapiens
gcacaagggatctac

SEQ ID NO: 1661 - DNA, 15 bp, Homo sapiens
ggcacaagggatcta

SEQ ID NO: 1662 - DNA, 15 bp, Homo sapiens
gggcacaagggatct

SEQ ID NO: 1663 - DNA, 15 bp, Homo sapiens
tgggcacaagggatc

SEQ ID NO: 1664 - DNA, 15 bp, Homo sapiens
ctgggcacaagggat

SEQ ID NO: 1665 - DNA, 15 bp, Homo sapiens
cctgggcacaaggga

SEQ ID NO: 1666 - DNA, 15 bp, Homo sapiens
tcctgggcacaaggg

SEQ ID NO: 1667 - DNA, 15 bp, Homo sapiens
ctcctgggcacaagg

SEQ ID NO: 1668 - DNA, 15 bp, Homo sapiens
actcctgggcacaag

SEQ ID NO: 1669 - DNA, 15 bp, Homo sapiens
aactcctgggcacaa

SEQ ID NO: 1670 - DNA, 15 bp, Homo sapiens
gaactcctgggcaca

SEQ ID NO: 1671 - DNA, 15 bp, Homo sapiens
tgaactcctgggcac

SEQ ID NO: 1672 - DNA, 15 bp, Homo sapiens
ttgaactcctgggca

SEQ ID NO: 1673 - DNA, 15 bp, Homo sapiens
cttgaactcctgggc

SEQ ID NO: 1674 - DNA, 15 bp, Homo sapiens
tcttgaactcctggg

SEQ ID NO: 1675 - DNA, 15 bp, Homo sapiens
gtcttgaactcctgg

SEQ ID NO: 1676 - DNA, 15 bp, Homo sapiens
cccaggctggtcttg

SEQ ID NO: 1677 - DNA, 15 bp, Homo sapiens
gcccaggctggtctt

SEQ ID NO: 1678 - DNA, 15 bp, Homo sapiens
tgcccaggctggtct

SEQ ID NO: 1679 - DNA, 15 bp, Homo sapiens
ttgcccaggctggtc

SEQ ID NO: 1680 - DNA, 15 bp, Homo sapiens
gttgcccaggctggt

SEQ ID NO: 1681 - DNA, 15 bp, Homo sapiens
tgttgcccaggctgg

SEQ ID NO: 1682 - DNA, 15 bp, Homo sapiens
atgttgcccaggctg

SEQ ID NO: 1683 - DNA, 15 bp, Homo sapiens
catgttgcccaggct

SEQ ID NO: 1684 - DNA, 15 bp, Homo sapiens
ccatgttgcccaggc

SEQ ID NO: 1685 - DNA, 15 bp, Homo sapiens
gccatgttgcccagg

SEQ ID NO: 1686 - DNA, 15 bp, Homo sapiens
cgccatgttgcccag

SEQ ID NO: 1687 - DNA, 15 bp, Homo sapiens
tcgccatgttgccca

SEQ ID NO: 1688 - DNA, 15 bp, Homo sapiens
ttcgccatgttgccc

SEQ ID NO: 1689 - DNA, 15 bp, Homo sapiens
tttcgccatgttgcc

SEQ ID NO: 1690 - DNA, 15 bp, Homo sapiens
gtttcgccatgttgc

SEQ ID NO: 1691 - DNA, 15 bp, Homo sapiens
ggtttcgccatgttg

SEQ ID NO: 1692 - DNA, 15 bp, Homo sapiens
gggtttcgccatgtt

SEQ ID NO: 1693 - DNA, 15 bp, Homo sapiens
ggggtttcgccatgt

SEQ ID NO: 1694 - DNA, 15 bp, Homo sapiens
tggggtttcgccatg

SEQ ID NO: 1695 - DNA, 15 bp, Homo sapiens
atggggtttcgccat

SEQ ID NO: 1696 - DNA, 15 bp, Homo sapiens
aatggggtttcgcca

SEQ ID NO: 1697 - DNA, 15 bp, Homo sapiens
aaatggggtttcgcc

SEQ ID NO: 1698 - DNA, 15 bp, Homo sapiens
gaaatggggtttcgc

SEQ ID NO: 1699 - DNA, 15 bp, Homo sapiens
agaaatggggtttcg

SEQ ID NO: 1700 - DNA, 15 bp, Homo sapiens
tagaaatggggtttc

SEQ ID NO: 1701 - DNA, 15 bp, Homo sapiens
gtagaaatggggttt

SEQ ID NO: 1702 - DNA, 15 bp, Homo sapiens
agtagaaatggggtt

SEQ ID NO: 1703 - DNA, 15 bp, Homo sapiens
tagtagaaatggggt

SEQ ID NO: 1704 - DNA, 15 bp, Homo sapiens
ttagtagaaatgggg

SEQ ID NO: 1705 - DNA, 15 bp, Homo sapiens
tttagtagaaatggg

SEQ ID NO: 1706 - DNA, 15 bp, Homo sapiens
ttttagtagaaatgg

SEQ ID NO: 1707 - DNA, 15 bp, Homo sapiens
tttttagtagaaatg

SEQ ID NO: 1708 - DNA, 15 bp, Homo sapiens
atttttagtagaaat

SEQ ID NO: 1709 - DNA, 15 bp, Homo sapiens
tatttttagtagaaa

SEQ ID NO: 1710 - DNA, 15 bp, Homo sapiens
gtatttttagtagaa

SEQ ID NO: 1711 - DNA, 15 bp, Homo sapiens
agctaatttttgtat

SEQ ID NO: 1712 - DNA, 15 bp, Homo sapiens
cagctaatttttgta

SEQ ID NO: 1713 - DNA, 15 bp, Homo sapiens
ccagctaatttttgt

SEQ ID NO: 1714 - DNA, 15 bp, Homo sapiens
cccagctaatttttg

SEQ ID NO: 1715 - DNA, 15 bp, Homo sapiens
ccccagctaattttt

SEQ ID NO: 1716 - DNA, 15 bp, Homo sapiens
gccccagctaatttt

SEQ ID NO: 1717 - DNA, 15 bp, Homo sapiens
cgccccagctaattt

SEQ ID NO: 1718 - DNA, 15 bp, Homo sapiens
tcgccccagctaatt

SEQ ID NO: 1719 - DNA, 15 bp, Homo sapiens
ctcgccccagctaat

SEQ ID NO: 1720 - DNA, 15 bp, Homo sapiens
cctcgccccagctaa

SEQ ID NO: 1721 - DNA, 15 bp, Homo sapiens
ccctcgccccagcta

SEQ ID NO: 1722 - DNA, 15 bp, Homo sapiens
cccctcgccccagct

SEQ ID NO: 1723 - DNA, 15 bp, Homo sapiens
tcccctcgccccagc

SEQ ID NO: 1724 - DNA, 15 bp, Homo sapiens
atcccctcgccccag

SEQ ID NO: 1725 - DNA, 15 bp, Homo sapiens
tatcccctcgcccca

SEQ ID NO: 1726 - DNA, 15 bp, Homo sapiens
ctatcccctcgcccc

SEQ ID NO: 1727 - DNA, 15 bp, Homo sapiens
cctatcccctcgccc

SEQ ID NO: 1728 - DNA, 15 bp, Homo sapiens
gcctatcccctcgcc

SEQ ID NO: 1729 - DNA, 15 bp, Homo sapiens
ggcctatcccctcgc

SEQ ID NO: 1730 - DNA, 15 bp, Homo sapiens
cggcctatcccctcg

SEQ ID NO: 1731 - DNA, 15 bp, Homo sapiens
tcggcctatcccctc

SEQ ID NO: 1732 - DNA, 15 bp, Homo sapiens
ctcggcctatcccct

SEQ ID NO: 1733 - DNA, 15 bp, Homo sapiens
actcggcctatcccc

SEQ ID NO: 1734 - DNA, 15 bp, Homo sapiens
aactcggcctatccc

SEQ ID NO: 1735 - DNA, 15 bp, Homo sapiens
gaactcggcctatcc

SEQ ID NO: 1736 - DNA, 15 bp, Homo sapiens
ggaactcggcctatc

SEQ ID NO: 1737 - DNA, 15 bp, Homo sapiens
cggaactcggcctat

SEQ ID NO: 1738 - DNA, 15 bp, Homo sapiens
ccggaactcggccta

SEQ ID NO: 1739 - DNA, 15 bp, Homo sapiens
cccggaactcggcct

SEQ ID NO: 1740 - DNA, 15 bp, Homo sapiens
acccggaactcggcc

SEQ ID NO: 1741 - DNA, 15 bp, Homo sapiens
cacccggaactcggc

SEQ ID NO: 1742 - DNA, 15 bp, Homo sapiens
acacccggaactcgg

SEQ ID NO: 1743 - DNA, 15 bp, Homo sapiens
tacacccggaactcg

SEQ ID NO: 1744 - DNA, 15 bp, Homo sapiens
ttacacccggaactc

SEQ ID NO: 1745 - DNA, 15 bp, Homo sapiens
cttacacccggaact

SEQ ID NO: 1746 - DNA, 15 bp, Homo sapiens
ccttacacccggaac

SEQ ID NO: 1747 - DNA, 15 bp, Homo sapiens
cccttacacccggaa

SEQ ID NO: 1748 - DNA, 15 bp, Homo sapiens
ccccttacacccgga

SEQ ID NO: 1749 - DNA, 15 bp, Homo sapiens
cccccttacacccgg

SEQ ID NO: 1750 - DNA, 15 bp, Homo sapiens
gcccccttacacccg

SEQ ID NO: 1751 - DNA, 15 bp, Homo sapiens
ggcccccttacaccc

SEQ ID NO: 1752 - DNA, 15 bp, Homo sapiens
tggcccccttacacc

SEQ ID NO: 1753 - DNA, 15 bp, Homo sapiens
atggcccccttacac

SEQ ID NO: 1754 - DNA, 15 bp, Homo sapiens
aatggcccccttaca

SEQ ID NO: 1755 - DNA, 15 bp, Homo sapiens
taatggcccccttac

SEQ ID NO: 1756 - DNA, 15 bp, Homo sapiens
ctaatggccccctta

SEQ ID NO: 1757 - DNA, 15 bp, Homo sapiens
cctaatggccccctt

SEQ ID NO: 1758 - DNA, 15 bp, Homo sapiens
ccctaatggccccct

SEQ ID NO: 1759 - DNA, 15 bp, Homo sapiens
tccctaatggccccc

SEQ ID NO: 1760 - DNA, 15 bp, Homo sapiens
ctccctaatggcccc

SEQ ID NO: 1761 - DNA, 15 bp, Homo sapiens
tctccctaatggccc

SEQ ID NO: 1762 - DNA, 15 bp, Homo sapiens
ctctccctaatggcc

SEQ ID NO: 1763 - DNA, 15 bp, Homo sapiens
gctctccctaatggc

SEQ ID NO: 1764 - DNA, 15 bp, Homo sapiens
tgctctccctaatgg

SEQ ID NO: 1765 - DNA, 15 bp, Homo sapiens
ctgctctccctaatg

SEQ ID NO: 1766 - DNA, 15 bp, Homo sapiens
tctgctctccctaat

SEQ ID NO: 1767 - DNA, 15 bp, Homo sapiens
ctctgctctccctaa

SEQ ID NO: 1768 - DNA, 15 bp, Homo sapiens
gctctgctctcccta

SEQ ID NO: 1769 - DNA, 15 bp, Homo sapiens
cgctctgctctccct

SEQ ID NO: 1770 - DNA, 15 bp, Homo sapiens
tcgctctgctctccc

SEQ ID NO: 1771 - DNA, 15 bp, Homo sapiens
ctcgctctgctctcc

SEQ ID NO: 1772 - DNA, 15 bp, Homo sapiens
cctcgctctgctctc

SEQ ID NO: 1773 - DNA, 15 bp, Homo sapiens
gcctcgctctgctct

SEQ ID NO: 1774 - DNA, 15 bp, Homo sapiens
tgcctcgctctgctc

SEQ ID NO: 1775 - DNA, 15 bp, Homo sapiens
ctgcctcgctctgct

SEQ ID NO: 1776 - DNA, 15 bp, Homo sapiens
gctgcctcgctctgc

SEQ ID NO: 1777 - DNA, 15 bp, Homo sapiens
agctgcctcgctctg

SEQ ID NO: 1778 - DNA, 15 bp, Homo sapiens
cagctgcctcgctct

SEQ ID NO: 1779 - DNA, 15 bp, Homo sapiens
tcagctgcctcgctc

SEQ ID NO: 1780 - DNA, 15 bp, Homo sapiens
atcagctgcctcgct

SEQ ID NO: 1781 - DNA, 15 bp, Homo sapiens
gatcagctgcctcgc

SEQ ID NO: 1782 - DNA, 15 bp, Homo sapiens
agatcagctgcctcg

SEQ ID NO: 1783 - DNA, 15 bp, Homo sapiens
aagatcagctgcctc

SEQ ID NO: 1784 - DNA, 15 bp, Homo sapiens
gaagatcagctgcct

SEQ ID NO: 1785 - DNA, 15 bp, Homo sapiens
ggaagatcagctgcc

SEQ ID NO: 1786 - DNA, 15 bp, Homo sapiens
cggaagatcagctgc

SEQ ID NO: 1787 - DNA, 15 bp, Homo sapiens
ccggaagatcagctg

SEQ ID NO: 1788 - DNA, 15 bp, Homo sapiens
tccggaagatcagct

SEQ ID NO: 1789 - DNA, 15 bp, Homo sapiens
atccggaagatcagc

SEQ ID NO: 1790 - DNA, 15 bp, Homo sapiens
aatccggaagatcag

SEQ ID NO: 1791 - DNA, 15 bp, Homo sapiens
caatccggaagatca

SEQ ID NO: 1792 - DNA, 15 bp, Homo sapiens
ccaatccggaagatc

SEQ ID NO: 1793 - DNA, 15 bp, Homo sapiens
cccaatccggaagat

SEQ ID NO: 1794 - DNA, 15 bp, Homo sapiens
ccccaatccggaaga

SEQ ID NO: 1795 - DNA, 15 bp, Homo sapiens
cccccaatccggaag

SEQ ID NO: 1796 - DNA, 15 bp, Homo sapiens
gcccccaatccggaa

SEQ ID NO: 1797 - DNA, 15 bp, Homo sapiens
ggcccccaatccgga

SEQ ID NO: 1798 - DNA, 15 bp, Homo sapiens
aggcccccaatccgg

SEQ ID NO: 1799 - DNA, 15 bp, Homo sapiens
aaggcccccaatccg

SEQ ID NO: 1800 - DNA, 15 bp, Homo sapiens
caaggcccccaatcc

SEQ ID NO: 1801 - DNA, 15 bp, Homo sapiens
gcaaggcccccaatc

SEQ ID NO: 1802 - DNA, 15 bp, Homo sapiens
ggcaaggcccccaat

SEQ ID NO: 1803 - DNA, 15 bp, Homo sapiens
gggcaaggcccccaa

SEQ ID NO: 1804 - DNA, 15 bp, Homo sapiens
cgggcaaggccccca

SEQ ID NO: 1805 - DNA, 15 bp, Homo sapiens
ccgggcaaggccccc

SEQ ID NO: 1806 - DNA, 15 bp, Homo sapiens
tccgggcaaggcccc

SEQ ID NO: 1807 - DNA, 15 bp, Homo sapiens
ttccgggcaaggccc

SEQ ID NO: 1808 - DNA, 15 bp, Homo sapiens
cttccgggcaaggcc

SEQ ID NO: 1809 - DNA, 15 bp, Homo sapiens
gcttccgggcaaggc

SEQ ID NO: 1810 - DNA, 15 bp, Homo sapiens
agcttccgggcaagg

SEQ ID NO: 1811 - DNA, 15 bp, Homo sapiens
cagcttccgggcaag

SEQ ID NO: 1812 - DNA, 15 bp, Homo sapiens
ccagcttccgggcaa

SEQ ID NO: 1813 - DNA, 15 bp, Homo sapiens
tccagcttccgggca

SEQ ID NO: 1814 - DNA, 15 bp, Homo sapiens
gtccagcttccgggc

SEQ ID NO: 1815 - DNA, 15 bp, Homo sapiens
ggtccagcttccggg

SEQ ID NO: 1816 - DNA, 15 bp, Homo sapiens
aggtccagcttccgg

SEQ ID NO: 1817 - DNA, 15 bp, Homo sapiens
gaggtccagcttccg

SEQ ID NO: 1818 - DNA, 15 bp, Homo sapiens
tgaggtccagcttcc

SEQ ID NO: 1819 - DNA, 15 bp, Homo sapiens
gtgaggtccagcttc

SEQ ID NO: 1820 - DNA, 15 bp, Homo sapiens
cgtgaggtccagctt

SEQ ID NO: 1821 - DNA, 15 bp, Homo sapiens
ccgtgaggtccagct

SEQ ID NO: 1822 - DNA, 15 bp, Homo sapiens
tccgtgaggtccagc

SEQ ID NO: 1823 - DNA, 15 bp, Homo sapiens
ctccgtgaggtccag

SEQ ID NO: 1824 - DNA, 15 bp, Homo sapiens
tctccgtgaggtcca

SEQ ID NO: 1825 - DNA, 15 bp, Homo sapiens
atctccgtgaggtcc

SEQ ID NO: 1826 - DNA, 15 bp, Homo sapiens
catctccgtgaggtc

SEQ ID NO: 1827 - DNA, 15 bp, Homo sapiens
tcatctccgtgaggt

SEQ ID NO: 1828 - DNA, 15 bp, Homo sapiens
ttcatctccgtgagg

SEQ ID NO: 1829 - DNA, 15 bp, Homo sapiens
tttcatctccgtgag

SEQ ID NO: 1830 - DNA, 15 bp, Homo sapiens
gtttcatctccgtga

SEQ ID NO: 1831 - DNA, 15 bp, Homo sapiens
cgtttcatctccgtg

SEQ ID NO: 1832 - DNA, 15 bp, Homo sapiens
ccgtttcatctccgt

SEQ ID NO: 1833 - DNA, 15 bp, Homo sapiens
tccgtttcatctccg

SEQ ID NO: 1834 - DNA, 15 bp, Homo sapiens
ttccgtttcatctcc

SEQ ID NO: 1835 - DNA, 15 bp, Homo sapiens
cttccgtttcatctc

SEQ ID NO: 1836 - DNA, 15 bp, Homo sapiens
tcttccgtttcatct

SEQ ID NO: 1837 - DNA, 15 bp, Homo sapiens
atcttccgtttcatc

SEQ ID NO: 1838 - DNA, 15 bp, Homo sapiens
catcttccgtttcat

SEQ ID NO: 1839 - DNA, 15 bp, Homo sapiens
gcatcttccgtttca

SEQ ID NO: 1840 - DNA, 15 bp, Homo sapiens
tgcatcttccgtttc

SEQ ID NO: 1841 - DNA, 15 bp, Homo sapiens
gtgcatcttccgttt

SEQ ID NO: 1842 - DNA, 15 bp, Homo sapiens
cgtgcatcttccgtt

SEQ ID NO: 1843 - DNA, 15 bp, Homo sapiens
tcgtgcatcttccgt

SEQ ID NO: 1844 - DNA, 15 bp, Homo sapiens
ctcgtgcatcttccg

SEQ ID NO: 1845 - DNA, 15 bp, Homo sapiens
cctcgtgcatcttcc

SEQ ID NO: 1846 - DNA, 15 bp, Homo sapiens
tcctcgtgcatcttc

SEQ ID NO: 1847 - DNA, 15 bp, Homo sapiens
atcctcgtgcatctt

SEQ ID NO: 1848 - DNA, 15 bp, Homo sapiens
tatcctcgtgcatct

SEQ ID NO: 1849 - DNA, 15 bp, Homo sapiens
atatcctcgtgcatc

SEQ ID NO: 1850 - DNA, 15 bp, Homo sapiens
catatcctcgtgcat

SEQ ID NO: 1851 - DNA, 15 bp, Homo sapiens
tcatatcctcgtgca

SEQ ID NO: 1852 - DNA, 15 bp, Homo sapiens
atcatatcctcgtgc

SEQ ID NO: 1853 - DNA, 15 bp, Homo sapiens
gatcatatcctcgtg

SEQ ID NO: 1854 - DNA, 15 bp, Homo sapiens
agatcatatcctcgt

SEQ ID NO: 1855 - DNA, 15 bp, Homo sapiens
gagatcatatcctcg

SEQ ID NO: 1856 - DNA, 15 bp, Homo sapiens
ggagatcatatcctc

SEQ ID NO: 1857 - DNA, 15 bp, Homo sapiens
tggagatcatatcct

SEQ ID NO: 1858 - DNA, 15 bp, Homo sapiens
atggagatcatatcc

SEQ ID NO: 1859 - DNA, 15 bp, Homo sapiens
tatggagatcatatc

SEQ ID NO: 1860 - DNA, 15 bp, Homo sapiens
gtatggagatcatat

SEQ ID NO: 1861 - DNA, 15 bp, Homo sapiens
tgtatggagatcata

SEQ ID NO: 1862 - DNA, 15 bp, Homo sapiens
ctgtatggagatcat

SEQ ID NO: 1863 - DNA, 15 bp, Homo sapiens
tctgtatggagatca

SEQ ID NO: 1864 - DNA, 15 bp, Homo sapiens
ttctgtatggagatc

SEQ ID NO: 1865 - DNA, 15 bp, Homo sapiens
gttctgtatggagat

SEQ ID NO: 1866 - DNA, 15 bp, Homo sapiens
agttctgtatggaga

SEQ ID NO: 1867 - DNA, 15 bp, Homo sapiens
aagttctgtatggag

SEQ ID NO: 1868 - DNA, 15 bp, Homo sapiens
aaagttctgtatgga

SEQ ID NO: 1869 - DNA, 15 bp, Homo sapiens
gaaagttctgtatgg

SEQ ID NO: 1870 - DNA, 15 bp, Homo sapiens
agaaagttctgtatg

SEQ ID NO: 1871 - DNA, 15 bp, Homo sapiens
gagaaagttctgtat

SEQ ID NO: 1872 - DNA, 15 bp, Homo sapiens
tgagaaagttctgta

SEQ ID NO: 1873 - DNA, 15 bp, Homo sapiens
atgagaaagttctgt

SEQ ID NO: 1874 - DNA, 15 bp, Homo sapiens
gatgagaaagttctg

SEQ ID NO: 1875 - DNA, 15 bp, Homo sapiens
agatgagaaagttct

SEQ ID NO: 1876 - DNA, 15 bp, Homo sapiens
tagatgagaaagttc

SEQ ID NO: 1877 - DNA, 15 bp, Homo sapiens
gtagatgagaaagtt

SEQ ID NO: 1878 - DNA, 15 bp, Homo sapiens
cgtagatgagaaagt

SEQ ID NO: 1879 - DNA, 15 bp, Homo sapiens
acgtagatgagaaag

SEQ ID NO: 1880 - DNA, 15 bp, Homo sapiens
cacgtagatgagaaa

SEQ ID NO: 1881 - DNA, 15 bp, Homo sapiens
ccacgtagatgagaa

SEQ ID NO: 1882 - DNA, 15 bp, Homo sapiens
gccacgtagatgaga

SEQ ID NO: 1883 - DNA, 15 bp, Homo sapiens
ggccacgtagatgag

SEQ ID NO: 1884 - DNA, 15 bp, Homo sapiens
gggccacgtagatga

SEQ ID NO: 1885 - DNA, 15 bp, Homo sapiens
agggccacgtagatg

SEQ ID NO: 1886 - DNA, 15 bp, Homo sapiens
cagggccacgtagat

SEQ ID NO: 1887 - DNA, 15 bp, Homo sapiens
gcagggccacgtaga

SEQ ID NO: 1888 - DNA, 15 bp, Homo sapiens
agcagggccacgtag

SEQ ID NO: 1889 - DNA, 15 bp, Homo sapiens
cagcagggccacgta

SEQ ID NO: 1890 - DNA, 15 bp, Homo sapiens
gcagcagggccacgt

SEQ ID NO: 1891 - DNA, 15 bp, Homo sapiens
cgcagcagggccacg

SEQ ID NO: 1892 - DNA, 15 bp, Homo sapiens
tcgcagcagggccac

SEQ ID NO: 1893 - DNA, 15 bp, Homo sapiens
ctcgcagcagggcca

SEQ ID NO: 1894 - DNA, 15 bp, Homo sapiens
actcgcagcagggcc

SEQ ID NO: 1895 - DNA, 15 bp, Homo sapiens
gactcgcagcagggc

SEQ ID NO: 1896 - DNA, 15 bp, Homo sapiens
tgactcgcagcaggg

SEQ ID NO: 1897 - DNA, 15 bp, Homo sapiens
gtgactcgcagcagg

SEQ ID NO: 1898 - DNA, 15 bp, Homo sapiens
agtgactcgcagcag

SEQ ID NO: 1899 - DNA, 15 bp, Homo sapiens
gagtgactcgcagca

SEQ ID NO: 1900 - DNA, 15 bp, Homo sapiens
ggagtgactcgcagc

SEQ ID NO: 1901 - DNA, 15 bp, Homo sapiens
tggagtgactcgcag

SEQ ID NO: 1902 - DNA, 15 bp, Homo sapiens
atggagtgactcgca

SEQ ID NO: 1903 - DNA, 15 bp, Homo sapiens
aatggagtgactcgc

SEQ ID NO: 1904 - DNA, 15 bp, Homo sapiens
aaatggagtgactcg

SEQ ID NO: 1905 - DNA, 15 bp, Homo sapiens
taaatggagtgactc

SEQ ID NO: 1906 - DNA, 15 bp, Homo sapiens
ataaatggagtgact

SEQ ID NO: 1907 - DNA, 15 bp, Homo sapiens
gataaatggagtgac

SEQ ID NO: 1908 - DNA, 15 bp, Homo sapiens
agataaatggagtga

SEQ ID NO: 1909 - DNA, 15 bp, Homo sapiens
aagataaatggagtg

SEQ ID NO: 1910 - DNA, 15 bp, Homo sapiens
taagataaatggagt

SEQ ID NO: 1911 - DNA, 15 bp, Homo sapiens
ttaagataaatggag

SEQ ID NO: 1912 - DNA, 15 bp, Homo sapiens
tttaagataaatgga

SEQ ID NO: 1913 - DNA, 15 bp, Homo sapiens
ctttaagataaatgg

SEQ ID NO: 1914 - DNA, 15 bp, Homo sapiens
tctttaagataaatg

SEQ ID NO: 1915 - DNA, 15 bp, Homo sapiens
ttctttaagataaat

SEQ ID NO: 1916 - DNA, 15 bp, Homo sapiens
tttctttaagataaa

SEQ ID NO: 1917 - DNA, 15 bp, Homo sapiens
atttctttaagataa

SEQ ID NO: 1918 - DNA, 15 bp, Homo sapiens
aatttctttaagata

SEQ ID NO: 1919 - DNA, 15 bp, Homo sapiens
caatttctttaagat

SEQ ID NO: 1920 - DNA, 15 bp, Homo sapiens
ccaatttctttaaga

SEQ ID NO: 1921 - DNA, 15 bp, Homo sapiens
tccaatttctttaag

SEQ ID NO: 1922 - DNA, 15 bp, Homo sapiens
gtccaatttctttaa

SEQ ID NO: 1923 - DNA, 15 bp, Homo sapiens
tgtccaatttcttta

SEQ ID NO: 1924 - DNA, 15 bp, Homo sapiens
ctgtccaatttcttt

SEQ ID NO: 1925 - DNA, 15 bp, Homo sapiens
gctgtccaatttctt

SEQ ID NO: 1926 - DNA, 15 bp, Homo sapiens
tgctgtccaatttct

SEQ ID NO: 1927 - DNA, 15 bp, Homo sapiens
atgctgtccaatttc

SEQ ID NO: 1928 - DNA, 15 bp, Homo sapiens
tatgctgtccaattt

SEQ ID NO: 1929 - DNA, 15 bp, Homo sapiens
atatgctgtccaatt

SEQ ID NO: 1930 - DNA, 15 bp, Homo sapiens
catatgctgtccaat

SEQ ID NO: 1931 - DNA, 15 bp, Homo sapiens
tcatatgctgtccaa

SEQ ID NO: 1932 - DNA, 15 bp, Homo sapiens
ttcatatgctgtcca

SEQ ID NO: 1933 - DNA, 15 bp, Homo sapiens
cttcatatgctgtcc

SEQ ID NO: 1934 - DNA, 15 bp, Homo sapiens
tcttcatatgctgtc

SEQ ID NO: 1935 - DNA, 15 bp, Homo sapiens
atcttcatatgctgt

SEQ ID NO: 1936 - DNA, 15 bp, Homo sapiens
aatcttcatatgctg

SEQ ID NO: 1937 - DNA, 15 bp, Homo sapiens
caatcttcatatgct

SEQ ID NO: 1938 - DNA, 15 bp, Homo sapiens
ccaatcttcatatgc

SEQ ID NO: 1939 - DNA, 15 bp, Homo sapiens
tccaatcttcatatg

SEQ ID NO: 1940 - DNA, 15 bp, Homo sapiens
gtccaatcttcatat

SEQ ID NO: 1941 - DNA, 15 bp, Homo sapiens
tgtccaatcttcata

SEQ ID NO: 1942 - DNA, 15 bp, Homo sapiens
atgtccaatcttcat

SEQ ID NO: 1943 - DNA, 15 bp, Homo sapiens
gatgtccaatcttca

SEQ ID NO: 1944 - DNA, 15 bp, Homo sapiens
tgatgtccaatcttc

SEQ ID NO: 1945 - DNA, 15 bp, Homo sapiens
gtgatgtccaatctt

SEQ ID NO: 1946 - DNA, 15 bp, Homo sapiens
tgtgatgtccaatct

SEQ ID NO: 1947 - DNA, 15 bp, Homo sapiens
atgtgatgtccaatc

SEQ ID NO: 1948 - DNA, 15 bp, Homo sapiens
catgtgatgtccaat

SEQ ID NO: 1949 - DNA, 15 bp, Homo sapiens
acatgtgatgtccaa

SEQ ID NO: 1950 - DNA, 15 bp, Homo sapiens
cacatgtgatgtcca

SEQ ID NO: 1951 - DNA, 15 bp, Homo sapiens
tcacatgtgatgtcc

SEQ ID NO: 1952 - DNA, 15 bp, Homo sapiens
ttcacatgtgatgtc

SEQ ID NO: 1953 - DNA, 15 bp, Homo sapiens
attcacatgtgatgt

SEQ ID NO: 1954 - DNA, 15 bp, Homo sapiens
cattcacatgtgatg

SEQ ID NO: 1955 - DNA, 15 bp, Homo sapiens
gcattcacatgtgat

SEQ ID NO: 1956 - DNA, 15 bp, Homo sapiens
tgcattcacatgtga

SEQ ID NO: 1957 - DNA, 15 bp, Homo sapiens
atgcattcacatgtg

SEQ ID NO: 1958 - DNA, 15 bp, Homo sapiens
catgcattcacatgt

SEQ ID NO: 1959 - DNA, 15 bp, Homo sapiens
tcatgcattcacatg

SEQ ID NO: 1960 - DNA, 15 bp, Homo sapiens
atcatgcattcacat

SEQ ID NO: 1961 - DNA, 15 bp, Homo sapiens
tatcatgcattcaca

SEQ ID NO: 1962 - DNA, 15 bp, Homo sapiens
atatcatgcattcac

SEQ ID NO: 1963 - DNA, 15 bp, Homo sapiens
catatcatgcattca

SEQ ID NO: 1964 - DNA, 15 bp, Homo sapiens
tcatatcatgcattc

SEQ ID NO: 1965 - DNA, 15 bp, Homo sapiens
ttcatatcatgcatt

SEQ ID NO: 1966 - DNA, 15 bp, Homo sapiens
cttcatatcatgcat

SEQ ID NO: 1967 - DNA, 15 bp, Homo sapiens
tcttcatatcatgca

SEQ ID NO: 1968 - DNA, 15 bp, Homo sapiens
ctcttcatatcatgc

SEQ ID NO: 1969 - DNA, 15 bp, Homo sapiens
gctcttcatatcatg

SEQ ID NO: 1970 - DNA, 15 bp, Homo sapiens
ggctcttcatatcat

SEQ ID NO: 1971 - DNA, 15 bp, Homo sapiens
aggctcttcatatca

SEQ ID NO: 1972 - DNA, 15 bp, Homo sapiens
caggctcttcatatc

SEQ ID NO: 1973 - DNA, 15 bp, Homo sapiens
ccaggctcttcatat

SEQ ID NO: 1974 - DNA, 15 bp, Homo sapiens
accaggctcttcata

SEQ ID NO: 1975 - DNA, 15 bp, Homo sapiens
aaccaggctcttcat

SEQ ID NO: 1976 - DNA, 15 bp, Homo sapiens
taaccaggctcttca

SEQ ID NO: 1977 - DNA, 15 bp, Homo sapiens
gtaaccaggctcttc

SEQ ID NO: 1978 - DNA, 15 bp, Homo sapiens
tgtaaccaggctctt

SEQ ID NO: 1979 - DNA, 15 bp, Homo sapiens
ctgtaaccaggctct

SEQ ID NO: 1980 - DNA, 15 bp, Homo sapiens
actgtaaccaggctc

SEQ ID NO: 1981 - DNA, 15 bp, Homo sapiens
aactgtaaccaggct

SEQ ID NO: 1982 - DNA, 15 bp, Homo sapiens
aaactgtaaccaggc

SEQ ID NO: 1983 - DNA, 15 bp, Homo sapiens
gaaactgtaaccagg

SEQ ID NO: 1984 - DNA, 15 bp, Homo sapiens
agaaactgtaaccag

SEQ ID NO: 1985 - DNA, 15 bp, Homo sapiens
tagaaactgtaacca

SEQ ID NO: 1986 - DNA, 15 bp, Homo sapiens
gtagaaactgtaacc

SEQ ID NO: 1987 - DNA, 15 bp, Homo sapiens
agtagaaactgtaac

SEQ ID NO: 1988 - DNA, 15 bp, Homo sapiens
cagtagaaactgtaa

SEQ ID NO: 1989 - DNA, 15 bp, Homo sapiens
acagtagaaactgta

SEQ ID NO: 1990 - DNA, 15 bp, Homo sapiens
aacagtagaaactgt

SEQ ID NO: 1991 - DNA, 15 bp, Homo sapiens
gaacagtagaaactg

SEQ ID NO: 1992 - DNA, 15 bp, Homo sapiens
agaacagtagaaact

SEQ ID NO: 1993 - DNA, 15 bp, Homo sapiens
gagaacagtagaaac

SEQ ID NO: 1994 - DNA, 15 bp, Homo sapiens
agagaacagtagaaa

SEQ ID NO: 1995 - DNA, 15 bp, Homo sapiens
cagagaacagtagaa

SEQ ID NO: 1996 - DNA, 15 bp, Homo sapiens
gcagagaacagtaga

SEQ ID NO: 1997 - DNA, 15 bp, Homo sapiens
tgcagagaacagtag

SEQ ID NO: 1998 - DNA, 15 bp, Homo sapiens
ttgcagagaacagta

SEQ ID NO: 1999 - DNA, 15 bp, Homo sapiens
cttgcagagaacagt

SEQ ID NO: 2000 - DNA, 15 bp, Homo sapiens
acttgcagagaacag

SEQ ID NO: 2001 - DNA, 15 bp, Homo sapiens
tacttgcagagaaca

SEQ ID NO: 2002 - DNA, 15 bp, Homo sapiens
ttacttgcagagaac

SEQ ID NO: 2003 - DNA, 15 bp, Homo sapiens
tttacttgcagagaa

SEQ ID NO: 2004 - DNA, 15 bp, Homo sapiens
atttacttgcagaga

SEQ ID NO: 2005 - DNA, 15 bp, Homo sapiens
tatttacttgcagag

SEQ ID NO: 2006 - DNA, 15 bp, Homo sapiens
ctatttacttgcaga

SEQ ID NO: 2007 - DNA, 15 bp, Homo sapiens
cctatttacttgcag

SEQ ID NO: 2008 - DNA, 15 bp, Homo sapiens
gcctatttacttgca

SEQ ID NO: 2009 - DNA, 15 bp, Homo sapiens
ggcctatttacttgc

SEQ ID NO: 2010 - DNA, 15 bp, Homo sapiens
gggcctatttacttg

SEQ ID NO: 2011 - DNA, 15 bp, Homo sapiens
tgggcctatttactt

SEQ ID NO: 2012 - DNA, 15 bp, Homo sapiens
ctgggcctatttact

SEQ ID NO: 2013 - DNA, 15 bp, Homo sapiens
tctgggcctatttac

SEQ ID NO: 2014 - DNA, 15 bp, Homo sapiens
ttctgggcctattta

SEQ ID NO: 2015 - DNA, 15 bp, Homo sapiens
tttctgggcctattt

SEQ ID NO: 2016 - DNA, 15 bp, Homo sapiens
ctttctgggcctatt

SEQ ID NO: 2017 - DNA, 15 bp, Homo sapiens
cctttctgggcctat

SEQ ID NO: 2018 - DNA, 15 bp, Homo sapiens
acctttctgggccta

SEQ ID NO: 2019 - DNA, 15 bp, Homo sapiens
tacctttctgggcct

SEQ ID NO: 2020 - DNA, 15 bp, Homo sapiens
atacctttctgggcc

SEQ ID NO: 2021 - DNA, 15 bp, Homo sapiens
tatacctttctgggc

SEQ ID NO: 2022 - DNA, 15 bp, Homo sapiens
ttatacctttctggg

SEQ ID NO: 2023 - DNA, 15 bp, Homo sapiens
cttatacctttctgg

SEQ ID NO: 2024 - DNA, 15 bp, Homo sapiens
tcttatacctttctg

SEQ ID NO: 2025 - DNA, 15 bp, Homo sapiens
ctcttatacctttct

SEQ ID NO: 2026 - DNA, 15 bp, Homo sapiens
tctcttatacctttc

SEQ ID NO: 2027 - DNA, 15 bp, Homo sapiens
gtctcttataccttt

SEQ ID NO: 2028 - DNA, 15 bp, Homo sapiens
agtctcttatacctt

SEQ ID NO: 2029 - DNA, 15 bp, Homo sapiens
gagtctcttatacct

SEQ ID NO: 2030 - DNA, 15 bp, Homo sapiens
agagtctcttatacc

SEQ ID NO: 2031 - DNA, 15 bp, Homo sapiens
aagagtctcttatac

SEQ ID NO: 2032 - DNA, 15 bp, Homo sapiens
aaagagtctcttata

SEQ ID NO: 2033 - DNA, 15 bp, Homo sapiens
caaagagtctcttat

SEQ ID NO: 2034 - DNA, 15 bp, Homo sapiens
tcaaagagtctctta

SEQ ID NO: 2035 - DNA, 15 bp, Homo sapiens
ttcaaagagtctctt

SEQ ID NO: 2036 - DNA, 15 bp, Homo sapiens
attcaaagagtctct

SEQ ID NO: 2037 - DNA, 15 bp, Homo sapiens
cattcaaagagtctc

SEQ ID NO: 2038 - DNA, 15 bp, Homo sapiens
ccattcaaagagtct

SEQ ID NO: 2039 - DNA, 15 bp, Homo sapiens
tccattcaaagagtc

SEQ ID NO: 2040 - DNA, 15 bp, Homo sapiens
gtccattcaaagagt

SEQ ID NO: 2041 - DNA, 15 bp, Homo sapiens
tgtccattcaaagag

SEQ ID NO: 2042 - DNA, 15 bp, Homo sapiens
atgtccattcaaaga

SEQ ID NO: 2043 - DNA, 15 bp, Homo sapiens
tatgtccattcaaag

SEQ ID NO: 2044 - DNA, 15 bp, Homo sapiens
ttatgtccattcaaa

SEQ ID NO: 2045 - DNA, 15 bp, Homo sapiens
tttatgtccattcaa

SEQ ID NO: 2046 - DNA, 15 bp, Homo sapiens
ttttatgtccattca

SEQ ID NO: 2047 - DNA, 15 bp, Homo sapiens
tttttatgtccattc

SEQ ID NO: 2048 - DNA, 15 bp, Homo sapiens
atttttatgtccatt

SEQ ID NO: 2049 - DNA, 15 bp, Homo sapiens
aatttttatgtccat

SEQ ID NO: 2050 - DNA, 15 bp, Homo sapiens
gaatttttatgtcca

SEQ ID NO: 2051 - DNA, 15 bp, Homo sapiens
agaatttttatgtcc

SEQ ID NO: 2052 - DNA, 15 bp, Homo sapiens
cagaatttttatgtc

SEQ ID NO: 2053 - DNA, 15 bp, Homo sapiens
gcagaatttttatgt

SEQ ID NO: 2054 - DNA, 15 bp, Homo sapiens
agcagaatttttatg

SEQ ID NO: 2055 - DNA, 15 bp, Homo sapiens
aagcagaatttttat

SEQ ID NO: 2056 - DNA, 15 bp, Homo sapiens
caagcagaattttta

SEQ ID NO: 2057 - DNA, 15 bp, Homo sapiens
acaagcagaattttt

SEQ ID NO: 2058 - DNA, 15 bp, Homo sapiens
aacaagcagaatttt

SEQ ID NO: 2059 - DNA, 15 bp, Homo sapiens
taacaagcagaattt

SEQ ID NO: 2060 - DNA, 15 bp, Homo sapiens
ttaacaagcagaatt

SEQ ID NO: 2061 - DNA, 15 bp, Homo sapiens
cttaacaagcagaat

SEQ ID NO: 2062 - DNA, 15 bp, Homo sapiens
tcttaacaagcagaa

SEQ ID NO: 2063 - DNA, 15 bp, Homo sapiens
ttcttaacaagcaga

SEQ ID NO: 2064 - DNA, 15 bp, Homo sapiens
gttcttaacaagcag

SEQ ID NO: 2065 - DNA, 15 bp, Homo sapiens
tgttcttaacaagca

SEQ ID NO: 2066 - DNA, 15 bp, Homo sapiens
ttgttcttaacaagc

SEQ ID NO: 2067 - DNA, 15 bp, Homo sapiens
cttgttcttaacaag

SEQ ID NO: 2068 - DNA, 15 bp, Homo sapiens
acttgttcttaacaa

SEQ ID NO: 2069 - DNA, 15 bp, Homo sapiens
aacttgttcttaaca

SEQ ID NO: 2070 - DNA, 15 bp, Homo sapiens
caacttgttcttaac

SEQ ID NO: 2071 - DNA, 15 bp, Homo sapiens
tcaacttgttcttaa

SEQ ID NO: 2072 - DNA, 15 bp, Homo sapiens
ctcaacttgttctta

SEQ ID NO: 2073 - DNA, 15 bp, Homo sapiens
gctcaacttgttctt

SEQ ID NO: 2074 - DNA, 15 bp, Homo sapiens
agctcaacttgttct

SEQ ID NO: 2075 - DNA, 15 bp, Homo sapiens
gagctcaacttgttc

SEQ ID NO: 2076 - DNA, 15 bp, Homo sapiens
agagctcaacttgtt

SEQ ID NO: 2077 - DNA, 15 bp, Homo sapiens
cagagctcaacttgt

SEQ ID NO: 2078 - DNA, 15 bp, Homo sapiens
ccagagctcaacttg

SEQ ID NO: 2079 - DNA, 15 bp, Homo sapiens
accagagctcaactt

SEQ ID NO: 2080 - DNA, 15 bp, Homo sapiens
taccagagctcaact

SEQ ID NO: 2081 - DNA, 15 bp, Homo sapiens
ttaccagagctcaac

SEQ ID NO: 2082 - DNA, 15 bp, Homo sapiens
gttaccagagctcaa

SEQ ID NO: 2083 - DNA, 15 bp, Homo sapiens
agttaccagagctca

SEQ ID NO: 2084 - DNA, 15 bp, Homo sapiens
cagttaccagagctc

SEQ ID NO: 2085 - DNA, 15 bp, Homo sapiens
tcagttaccagagct

SEQ ID NO: 2086 - DNA, 15 bp, Homo sapiens
atcagttaccagagc

SEQ ID NO: 2087 - DNA, 15 bp, Homo sapiens
gatcagttaccagag

SEQ ID NO: 2088 - DNA, 15 bp, Homo sapiens
agatcagttaccaga

SEQ ID NO: 2089 - DNA, 15 bp, Homo sapiens
aagatcagttaccag

SEQ ID NO: 2090 - DNA, 15 bp, Homo sapiens
taagatcagttacca

SEQ ID NO: 2091 - DNA, 15 bp, Homo sapiens
ttaagatcagttacc

SEQ ID NO: 2092 - DNA, 15 bp, Homo sapiens
attaagatcagttac

SEQ ID NO: 2093 - DNA, 15 bp, Homo sapiens
tattaagatcagtta

SEQ ID NO: 2094 - DNA, 15 bp, Homo sapiens
ctattaagatcagtt

SEQ ID NO: 2095 - DNA, 15 bp, Homo sapiens
gctattaagatcagt

SEQ ID NO: 2096 - DNA, 15 bp, Homo sapiens
agctattaagatcag

SEQ ID NO: 2097 - DNA, 15 bp, Homo sapiens
tagctattaagatca

SEQ ID NO: 2098 - DNA, 15 bp, Homo sapiens
ttagctattaagatc

SEQ ID NO: 2099 - DNA, 15 bp, Homo sapiens
tttagctattaagat

SEQ ID NO: 2100 - DNA, 15 bp, Homo sapiens
ttttagctattaaga

SEQ ID NO: 2101 - DNA, 15 bp, Homo sapiens
attttagctattaag

SEQ ID NO: 2102 - DNA, 15 bp, Homo sapiens
tattttagctattaa

SEQ ID NO: 2103 - DNA, 15 bp, Homo sapiens
atattttagctatta

SEQ ID NO: 2104 - DNA, 15 bp, Homo sapiens
tatattttagctatt

SEQ ID NO: 2105 - DNA, 15 bp, Homo sapiens
ttatattttagctat

SEQ ID NO: 2106 - DNA, 15 bp, Homo sapiens
tttatattttagcta

SEQ ID NO: 2107 - DNA, 15 bp, Homo sapiens
ttttatattttagct

SEQ ID NO: 2108 - DNA, 15 bp, Homo sapiens
tttttatattttagc

SEQ ID NO: 2109 - DNA, 15 bp, Homo sapiens
atttttatattttag

SEQ ID NO: 2110 - DNA, 15 bp, Homo sapiens
tatttttatatttta

SEQ ID NO: 2111 - DNA, 15 bp, Homo sapiens
atatttttatatttt

SEQ ID NO: 2112 - DNA, 15 bp, Homo sapiens
aatatttttatattt

SEQ ID NO: 2113 - DNA, 15 bp, Homo sapiens
aaatatttttatatt

SEQ ID NO: 2114 - DNA, 15 bp, Homo sapiens
caaatatttttatat

SEQ ID NO: 2115 - DNA, 15 bp, Homo sapiens
ccaaatatttttata

SEQ ID NO: 2116 - DNA, 15 bp, Homo sapiens
cccaaatatttttat

SEQ ID NO: 2117 - DNA, 15 bp, Homo sapiens
tcccaaatattttta

SEQ ID NO: 2118 - DNA, 15 bp, Homo sapiens
ttcccaaatattttt

SEQ ID NO: 2119 - DNA, 15 bp, Homo sapiens
cttcccaaatatttt

SEQ ID NO: 2120 - DNA, 15 bp, Homo sapiens
acttcccaaatattt

SEQ ID NO: 2121 - DNA, 15 bp, Homo sapiens
gacttcccaaatatt

SEQ ID NO: 2122 - DNA, 15 bp, Homo sapiens
agacttcccaaatat

SEQ ID NO: 2123 - DNA, 15 bp, Homo sapiens
cagacttcccaaata

SEQ ID NO: 2124 - DNA, 15 bp, Homo sapiens
tcagacttcccaaat

SEQ ID NO: 2125 - DNA, 15 bp, Homo sapiens
ttcagacttcccaaa

SEQ ID NO: 2126 - DNA, 15 bp, Homo sapiens
tttcagacttcccaa

SEQ ID NO: 2127 - DNA, 15 bp, Homo sapiens
atttcagacttccca

SEQ ID NO: 2128 - DNA, 15 bp, Homo sapiens
catttcagacttccc

SEQ ID NO: 2129 - DNA, 15 bp, Homo sapiens
tcatttcagacttcc

SEQ ID NO: 2130 - DNA, 15 bp, Homo sapiens
ctcatttcagacttc

SEQ ID NO: 2131 - DNA, 15 bp, Homo sapiens
cctcatttcagactt

SEQ ID NO: 2132 - DNA, 15 bp, Homo sapiens
acctcatttcagact

SEQ ID NO: 2133 - DNA, 15 bp, Homo sapiens
gacctcatttcagac

SEQ ID NO: 2134 - DNA, 15 bp, Homo sapiens
agacctcatttcaga

SEQ ID NO: 2135 - DNA, 15 bp, Homo sapiens
gagacctcatttcag

SEQ ID NO: 2136 - DNA, 15 bp, Homo sapiens
ggagacctcatttca

SEQ ID NO: 2137 - DNA, 15 bp, Homo sapiens
aggagacctcatttc

SEQ ID NO: 2138 - DNA, 15 bp, Homo sapiens
caggagacctcattt

SEQ ID NO: 2139 - DNA, 15 bp, Homo sapiens
ccaggagacctcatt

SEQ ID NO: 2140 - DNA, 15 bp, Homo sapiens
gccaggagacctcat

SEQ ID NO: 2141 - DNA, 15 bp, Homo sapiens
ggccaggagacctca

SEQ ID NO: 2142 - DNA, 15 bp, Homo sapiens
gggccaggagacctc

SEQ ID NO: 2143 - DNA, 15 bp, Homo sapiens
agggccaggagacct

SEQ ID NO: 2144 - DNA, 15 bp, Homo sapiens
cagggccaggagacc

SEQ ID NO: 2145 - DNA, 15 bp, Homo sapiens
ccagggccaggagac

SEQ ID NO: 2146 - DNA, 15 bp, Homo sapiens
accagggccaggaga

SEQ ID NO: 2147 - DNA, 15 bp, Homo sapiens
caccagggccaggag

SEQ ID NO: 2148 - DNA, 15 bp, Homo sapiens
acaccagggccagga

SEQ ID NO: 2149 - DNA, 15 bp, Homo sapiens
cacaccagggccagg

SEQ ID NO: 2150 - DNA, 15 bp, Homo sapiens
gcacaccagggccag

SEQ ID NO: 2151 - DNA, 15 bp, Homo sapiens
ggcacaccagggcca

SEQ ID NO: 2152 - DNA, 15 bp, Homo sapiens
gggcacaccagggcc

SEQ ID NO: 2153 - DNA, 15 bp, Homo sapiens
agggcacaccagggc

SEQ ID NO: 2154 - DNA, 15 bp, Homo sapiens
aagggcacaccaggg

SEQ ID NO: 2155 - DNA, 15 bp, Homo sapiens
taagggcacaccagg

SEQ ID NO: 2156 - DNA, 15 bp, Homo sapiens
ttaagggcacaccag

SEQ ID NO: 2157 - DNA, 15 bp, Homo sapiens
attaagggcacacca

SEQ ID NO: 2158 - DNA, 15 bp, Homo sapiens
cattaagggcacacc

SEQ ID NO: 2159 - DNA, 15 bp, Homo sapiens
gcattaagggcacac

SEQ ID NO: 2160 - DNA, 15 bp, Homo sapiens
ggcattaagggcaca

SEQ ID NO: 2161 - DNA, 15 bp, Homo sapiens
aggcattaagggcac

SEQ ID NO: 2162 - DNA, 15 bp, Homo sapiens
caggcattaagggca

SEQ ID NO: 2163 - DNA, 15 bp, Homo sapiens
acaggcattaagggc

SEQ ID NO: 2164 - DNA, 15 bp, Homo sapiens
cacaggcattaaggg

SEQ ID NO: 2165 - DNA, 15 bp, Homo sapiens
tcacaggcattaagg

SEQ ID NO: 2166 - DNA, 15 bp, Homo sapiens
gtcacaggcattaag

SEQ ID NO: 2167 - DNA, 15 bp, Homo sapiens
tgtcacaggcattaa

SEQ ID NO: 2168 - DNA, 15 bp, Homo sapiens
ctgtcacaggcatta

SEQ ID NO: 2169 - DNA, 15 bp, Homo sapiens
actgtcacaggcatt

SEQ ID NO: 2170 - DNA, 15 bp, Homo sapiens
aactgtcacaggcat

SEQ ID NO: 2171 - DNA, 15 bp, Homo sapiens
caactgtcacaggca

SEQ ID NO: 2172 - DNA, 15 bp, Homo sapiens
ccaactgtcacaggc

SEQ ID NO: 2173 - DNA, 15 bp, Homo sapiens
gccaactgtcacagg

SEQ ID NO: 2174 - DNA, 15 bp, Homo sapiens
ggccaactgtcacag

SEQ ID NO: 2175 - DNA, 15 bp, Homo sapiens
aggccaactgtcaca

SEQ ID NO: 2176 - DNA, 15 bp, Homo sapiens
gaggccaactgtcac

SEQ ID NO: 2177 - DNA, 15 bp, Homo sapiens
agaggccaactgtca

SEQ ID NO: 2178 - DNA, 15 bp, Homo sapiens
cagaggccaactgtc

SEQ ID NO: 2179 - DNA, 15 bp, Homo sapiens
acagaggccaactgt

SEQ ID NO: 2180 - DNA, 15 bp, Homo sapiens
cacagaggccaactg

SEQ ID NO: 2181 - DNA, 15 bp, Homo sapiens
tcacagaggccaact

SEQ ID NO: 2182 - DNA, 15 bp, Homo sapiens
ttcacagaggccaac

SEQ ID NO: 2183 - DNA, 15 bp, Homo sapiens
attcacagaggccaa

SEQ ID NO: 2184 - DNA, 15 bp, Homo sapiens
tattcacagaggcca

SEQ ID NO: 2185 - DNA, 15 bp, Homo sapiens
atattcacagaggcc

SEQ ID NO: 2186 - DNA, 15 bp, Homo sapiens
aatattcacagaggc

SEQ ID NO: 2187 - DNA, 15 bp, Homo sapiens
caatattcacagagg

SEQ ID NO: 2188 - DNA, 15 bp, Homo sapiens
ccaatattcacagag

SEQ ID NO: 2189 - DNA, 15 bp, Homo sapiens
accaatattcacaga

SEQ ID NO: 2190 - DNA, 15 bp, Homo sapiens
taccaatattcacag

SEQ ID NO: 2191 - DNA, 15 bp, Homo sapiens
ataccaatattcaca

SEQ ID NO: 2192 - DNA, 15 bp, Homo sapiens
tataccaatattcac

SEQ ID NO: 2193 - DNA, 15 bp, Homo sapiens
ttataccaatattca

SEQ ID NO: 2194 - DNA, 15 bp, Homo sapiens
attataccaatattc

SEQ ID NO: 2195 - DNA, 15 bp, Homo sapiens
aattataccaatatt

SEQ ID NO: 2196 - DNA, 15 bp, Homo sapiens
caattataccaatat

SEQ ID NO: 2197 - DNA, 15 bp, Homo sapiens
acaattataccaata

SEQ ID NO: 2198 - DNA, 15 bp, Homo sapiens
tacaattataccaat

SEQ ID NO: 2199 - DNA, 15 bp, Homo sapiens
ttacaattataccaa

SEQ ID NO: 2200 - DNA, 15 bp, Homo sapiens
tttacaattatacca

SEQ ID NO: 2201 - DNA, 15 bp, Homo sapiens
atttacaattatacc

SEQ ID NO: 2202 - DNA, 15 bp, Homo sapiens
tatttacaattatac

SEQ ID NO: 2203 - DNA, 15 bp, Homo sapiens
ttatttacaattata

SEQ ID NO: 2204 - DNA, 15 bp, Homo sapiens
attatttacaattat

SEQ ID NO: 2205 - DNA, 15 bp, Homo sapiens
cattatttacaatta

SEQ ID NO: 2206 - DNA, 15 bp, Homo sapiens
acattatttacaatt

SEQ ID NO: 2207 - DNA, 15 bp, Homo sapiens
gacattatttacaat

SEQ ID NO: 2208 - DNA, 15 bp, Homo sapiens
tgacattatttacaa

SEQ ID NO: 2209 - DNA, 15 bp, Homo sapiens
ttgacattatttaca

SEQ ID NO: 2210 - DNA, 15 bp, Homo sapiens
tttgacattatttac

SEQ ID NO: 2211 - DNA, 15 bp, Homo sapiens
gtttgacattattta

SEQ ID NO: 2212 - DNA, 15 bp, Homo sapiens
agtttgacattattt

SEQ ID NO: 2213 - DNA, 15 bp, Homo sapiens
gagtttgacattatt

SEQ ID NO: 2214 - DNA, 15 bp, Homo sapiens
ggagtttgacattat

SEQ ID NO: 2215 - DNA, 15 bp, Homo sapiens
tggagtttgacatta

SEQ ID NO: 2216 - DNA, 15 bp, Homo sapiens
atggagtttgacatt

SEQ ID NO: 2217 - DNA, 15 bp, Homo sapiens
aatggagtttgacat

SEQ ID NO: 2218 - DNA, 15 bp, Homo sapiens
aaatggagtttgaca

SEQ ID NO: 2219 - DNA, 15 bp, Homo sapiens
aaaatggagtttgac

SEQ ID NO: 2220 - DNA, 15 bp, Homo sapiens
gaaaatggagtttga

SEQ ID NO: 2221 - DNA, 15 bp, Homo sapiens
agaaaatggagtttg

SEQ ID NO: 2222 - DNA, 15 bp, Homo sapiens
tagaaaatggagttt

SEQ ID NO: 2223 - DNA, 15 bp, Homo sapiens
ctagaaaatggagtt

SEQ ID NO: 2224 - DNA, 15 bp, Homo sapiens
gctagaaaatggagt

SEQ ID NO: 2225 - DNA, 15 bp, Homo sapiens
tgctagaaaatggag

SEQ ID NO: 2226 - DNA, 15 bp, Homo sapiens
ttgctagaaaatgga

SEQ ID NO: 2227 - DNA, 15 bp, Homo sapiens
cttgctagaaaatgg

SEQ ID NO: 2228 - DNA, 15 bp, Homo sapiens
acttgctagaaaatg

SEQ ID NO: 2229 - DNA, 15 bp, Homo sapiens
tacttgctagaaaat

SEQ ID NO: 2230 - DNA, 15 bp, Homo sapiens
atacttgctagaaaa

SEQ ID NO: 2231 - DNA, 15 bp, Homo sapiens
aatacttgctagaaa

SEQ ID NO: 2232 - DNA, 15 bp, Homo sapiens
taatacttgctagaa

SEQ ID NO: 2233 - DNA, 15 bp, Homo sapiens
ttaatacttgctaga

SEQ ID NO: 2234 - DNA, 15 bp, Homo sapiens
attaatacttgctag

SEQ ID NO: 2235 - DNA, 15 bp, Homo sapiens
tattaatacttgcta

SEQ ID NO: 2236 - DNA, 15 bp, Homo sapiens
ttattaatacttgct

SEQ ID NO: 2237 - DNA, 15 bp, Homo sapiens
attattaatacttgc

SEQ ID NO: 2238 - DNA, 15 bp, Homo sapiens
aattattaatacttg

SEQ ID NO: 2239 - DNA, 15 bp, Homo sapiens
taattattaatactt

SEQ ID NO: 2240 - DNA, 15 bp, Homo sapiens
ttaattattaatact

SEQ ID NO: 2241 - DNA, 15 bp, Homo sapiens
cttaattattaatac

SEQ ID NO: 2242 - DNA, 15 bp, Homo sapiens
ccttaattattaata

SEQ ID NO: 2243 - DNA, 15 bp, Homo sapiens
cccttaattattaat

SEQ ID NO: 2244 - DNA, 15 bp, Homo sapiens
tcccttaattattaa

SEQ ID NO: 2245 - DNA, 15 bp, Homo sapiens
ttcccttaattatta

SEQ ID NO: 2246 - DNA, 15 bp, Homo sapiens
cttcccttaattatt

SEQ ID NO: 2247 - DNA, 15 bp, Homo sapiens
acttcccttaattat

SEQ ID NO: 2248 - DNA, 15 bp, Homo sapiens
tacttcccttaatta

SEQ ID NO: 2249 - DNA, 15 bp, Homo sapiens
atacttcccttaatt

SEQ ID NO: 2250 - DNA, 15 bp, Homo sapiens
catacttcccttaat

SEQ ID NO: 2251 - DNA, 15 bp, Homo sapiens
acatacttcccttaa

SEQ ID NO: 2252 - DNA, 15 bp, Homo sapiens
gacatacttccctta

SEQ ID NO: 2253 - DNA, 15 bp, Homo sapiens
agacatacttccctt

SEQ ID NO: 2254 - DNA, 15 bp, Homo sapiens
cagacatacttccct

SEQ ID NO: 2255 - DNA, 15 bp, Homo sapiens
tcagacatacttccc

SEQ ID NO: 2256 - DNA, 15 bp, Homo sapiens
ttcagacatacttcc

SEQ ID NO: 2257 - DNA, 15 bp, Homo sapiens
tttcagacatacttc

SEQ ID NO: 2258 - DNA, 15 bp, Homo sapiens
atttcagacatactt

SEQ ID NO: 2259 - DNA, 15 bp, Homo sapiens
catttcagacatact

SEQ ID NO: 2260 - DNA, 15 bp, Homo sapiens
ccatttcagacatac

SEQ ID NO: 2261 - DNA, 15 bp, Homo sapiens
gccatttcagacata

SEQ ID NO: 2262 - DNA, 15 bp, Homo sapiens
tgccatttcagacat

SEQ ID NO: 2263 - DNA, 15 bp, Homo sapiens
gtgccatttcagaca

SEQ ID NO: 2264 - DNA, 15 bp, Homo sapiens
agtgccatttcagac

SEQ ID NO: 2265 - DNA, 15 bp, Homo sapiens
cagtgccatttcaga

SEQ ID NO: 2266 - DNA, 15 bp, Homo sapiens
acagtgccatttcag

SEQ ID NO: 2267 - DNA, 15 bp, Homo sapiens
gacagtgccatttca

SEQ ID NO: 2268 - DNA, 15 bp, Homo sapiens
agacagtgccatttc

SEQ ID NO: 2269 - DNA, 15 bp, Homo sapiens
aagacagtgccattt

SEQ ID NO: 2270 - DNA, 15 bp, Homo sapiens
caagacagtgccatt

SEQ ID NO: 2271 - DNA, 15 bp, Homo sapiens
acaagacagtgccat

SEQ ID NO: 2272 - DNA, 15 bp, Homo sapiens
gacaagacagtgcca

SEQ ID NO: 2273 - DNA, 15 bp, Homo sapiens
tgacaagacagtgcc

SEQ ID NO: 2274 - DNA, 15 bp, Homo sapiens
ctgacaagacagtgc

SEQ ID NO: 2275 - DNA, 15 bp, Homo sapiens
actgacaagacagtg

SEQ ID NO: 2276 - DNA, 15 bp, Homo sapiens
gactgacaagacagt

SEQ ID NO: 2277 - DNA, 15 bp, Homo sapiens
tgactgacaagacag

SEQ ID NO: 2278 - DNA, 15 bp, Homo sapiens
atgactgacaagaca

SEQ ID NO: 2279 - DNA, 15 bp, Homo sapiens
aatgactgacaagac

SEQ ID NO: 2280 - DNA, 15 bp, Homo sapiens
aaatgactgacaaga

SEQ ID NO: 2281 - DNA, 15 bp, Homo sapiens
gaaatgactgacaag

SEQ ID NO: 2282 - DNA, 15 bp, Homo sapiens
agaaatgactgacaa

SEQ ID NO: 2283 - DNA, 15 bp, Homo sapiens
cagaaatgactgaca

SEQ ID NO: 2284 - DNA, 15 bp, Homo sapiens
acagaaatgactgac

SEQ ID NO: 2285 - DNA, 15 bp, Homo sapiens
aacagaaatgactga

SEQ ID NO: 2286 - DNA, 15 bp, Homo sapiens
aaacagaaatgactg

SEQ ID NO: 2287 - DNA, 15 bp, Homo sapiens
taaacagaaatgact

SEQ ID NO: 2288 - DNA, 15 bp, Homo sapiens
gtaaacagaaatgac

SEQ ID NO: 2289 - DNA, 15 bp, Homo sapiens
ggtaaacagaaatga

SEQ ID NO: 2290 - DNA, 15 bp, Homo sapiens
gggtaaacagaaatg

SEQ ID NO: 2291 - DNA, 15 bp, Homo sapiens
agggtaaacagaaat

SEQ ID NO: 2292 - DNA, 15 bp, Homo sapiens
aagggtaaacagaaa

SEQ ID NO: 2293 - DNA, 15 bp, Homo sapiens
gaagggtaaacagaa

SEQ ID NO: 2294 - DNA, 15 bp, Homo sapiens
agaagggtaaacaga

SEQ ID NO: 2295 - DNA, 15 bp, Homo sapiens
cagaagggtaaacag

SEQ ID NO: 2296 - DNA, 15 bp, Homo sapiens
acagaagggtaaaca

SEQ ID NO: 2297 - DNA, 15 bp, Homo sapiens
gacagaagggtaaac

SEQ ID NO: 2298 - DNA, 15 bp, Homo sapiens
agacagaagggtaaa

SEQ ID NO: 2299 - DNA, 15 bp, Homo sapiens
cagacagaagggtaa

SEQ ID NO: 2300 - DNA, 15 bp, Homo sapiens
ccagacagaagggta

SEQ ID NO: 2301 - DNA, 15 bp, Homo sapiens
tccagacagaagggt

SEQ ID NO: 2302 - DNA, 15 bp, Homo sapiens
ctccagacagaaggg

SEQ ID NO: 2303 - DNA, 15 bp, Homo sapiens
actccagacagaagg

SEQ ID NO: 2304 - DNA, 15 bp, Homo sapiens
cactccagacagaag

SEQ ID NO: 2305 - DNA, 15 bp, Homo sapiens
acactccagacagaa

SEQ ID NO: 2306 - DNA, 15 bp, Homo sapiens
tacactccagacaga

SEQ ID NO: 2307 - DNA, 15 bp, Homo sapiens
atacactccagacag

SEQ ID NO: 2308 - DNA, 15 bp, Homo sapiens
aatacactccagaca

SEQ ID NO: 2309 - DNA, 15 bp, Homo sapiens
aaatacactccagac

SEQ ID NO: 2310 - DNA, 15 bp, Homo sapiens
caaatacactccaga

SEQ ID NO: 2311 - DNA, 15 bp, Homo sapiens
acaaatacactccag

SEQ ID NO: 2312 - DNA, 15 bp, Homo sapiens
cacaaatacactcca

SEQ ID NO: 2313 - DNA, 15 bp, Homo sapiens
tcacaaatacactcc

SEQ ID NO: 2314 - DNA, 15 bp, Homo sapiens
ttcacaaatacactc

SEQ ID NO: 2315 - DNA, 15 bp, Homo sapiens
cttcacaaatacact

SEQ ID NO: 2316 - DNA, 15 bp, Homo sapiens
tcttcacaaatacac

SEQ ID NO: 2317 - DNA, 15 bp, Homo sapiens
ctcttcacaaataca

SEQ ID NO: 2318 - DNA, 15 bp, Homo sapiens
actcttcacaaatac

SEQ ID NO: 2319 - DNA, 15 bp, Homo sapiens
gactcttcacaaata

SEQ ID NO: 2320 - DNA, 15 bp, Homo sapiens
ggactcttcacaaat

SEQ ID NO: 2321 - DNA, 15 bp, Homo sapiens
gggactcttcacaaa

SEQ ID NO: 2322 - DNA, 15 bp, Homo sapiens
agggactcttcacaa

SEQ ID NO: 2323 - DNA, 15 bp, Homo sapiens
aagggactcttcaca

SEQ ID NO: 2324 - DNA, 15 bp, Homo sapiens
taagggactcttcac

SEQ ID NO: 2325 - DNA, 15 bp, Homo sapiens
ataagggactcttca

SEQ ID NO: 2326 - DNA, 15 bp, Homo sapiens
tataagggactcttc

SEQ ID NO: 2327 - DNA, 15 bp, Homo sapiens
ttataagggactctt

SEQ ID NO: 2328 - DNA, 15 bp, Homo sapiens
gttataagggactct

SEQ ID NO: 2329 - DNA, 15 bp, Homo sapiens
agttataagggactc

SEQ ID NO: 2330 - DNA, 15 bp, Homo sapiens
aagttataagggact

SEQ ID NO: 2331 - DNA, 15 bp, Homo sapiens
taagttataagggac

SEQ ID NO: 2332 - DNA, 15 bp, Homo sapiens
ataagttataaggga

SEQ ID NO: 2333 - DNA, 15 bp, Homo sapiens
cataagttataaggg

SEQ ID NO: 2334 - DNA, 15 bp, Homo sapiens
acataagttataagg

SEQ ID NO: 2335 - DNA, 15 bp, Homo sapiens
aacataagttataag

SEQ ID NO: 2336 - DNA, 15 bp, Homo sapiens
aaacataagttataa

SEQ ID NO: 2337 - DNA, 15 bp, Homo sapiens
aaaacataagttata

SEQ ID NO: 2338 - DNA, 15 bp, Homo sapiens
taaaacataagttat

SEQ ID NO: 2339 - DNA, 15 bp, Homo sapiens
ataaaacataagtta

SEQ ID NO: 2340 - DNA, 15 bp, Homo sapiens
cataaaacataagtt

SEQ ID NO: 2341 - DNA, 15 bp, Homo sapiens
ccataaaacataagt

SEQ ID NO: 2342 - DNA, 15 bp, Homo sapiens
tccataaaacataag

SEQ ID NO: 2343 - DNA, 15 bp, Homo sapiens
gtccataaaacataa

SEQ ID NO: 2344 - DNA, 15 bp, Homo sapiens
tgtccataaaacata

SEQ ID NO: 2345 - DNA, 15 bp, Homo sapiens
atgtccataaaacat

SEQ ID NO: 2346 - DNA, 15 bp, Homo sapiens
gatgtccataaaaca

SEQ ID NO: 2347 - DNA, 15 bp, Homo sapiens
tgatgtccataaaac

SEQ ID NO: 2348 - DNA, 15 bp, Homo sapiens
ctgatgtccataaaa

SEQ ID NO: 2349 - DNA, 15 bp, Homo sapiens
gctgatgtccataaa

SEQ ID NO: 2350 - DNA, 15 bp, Homo sapiens
tgctgatgtccataa

SEQ ID NO: 2351 - DNA, 15 bp, Homo sapiens
gtgctgatgtccata

SEQ ID NO: 2352 - DNA, 15 bp, Homo sapiens
tgtgctgatgtccat

SEQ ID NO: 2353 - DNA, 15 bp, Homo sapiens
atgtgctgatgtcca

SEQ ID NO: 2354 - DNA, 15 bp, Homo sapiens
tatgtgctgatgtcc

SEQ ID NO: 2355 - DNA, 15 bp, Homo sapiens
ttatgtgctgatgtc

SEQ ID NO: 2356 - DNA, 15 bp, Homo sapiens
gttatgtgctgatgt

SEQ ID NO: 2357 - DNA, 15 bp, Homo sapiens
ggttatgtgctgatg

SEQ ID NO: 2358 - DNA, 15 bp, Homo sapiens
tggttatgtgctgat

SEQ ID NO: 2359 - DNA, 15 bp, Homo sapiens
gtggttatgtgctga

SEQ ID NO: 2360 - DNA, 15 bp, Homo sapiens
tgtggttatgtgctg

SEQ ID NO: 2361 - DNA, 15 bp, Homo sapiens
ttgtggttatgtgct

SEQ ID NO: 2362 - DNA, 15 bp, Homo sapiens
attgtggttatgtgc

SEQ ID NO: 2363 - DNA, 15 bp, Homo sapiens
cattgtggttatgtg

SEQ ID NO: 2364 - DNA, 15 bp, Homo sapiens
tcattgtggttatgt

SEQ ID NO: 2365 - DNA, 15 bp, Homo sapiens
gtcattgtggttatg

SEQ ID NO: 2366 - DNA, 15 bp, Homo sapiens
tgtcattgtggttat

SEQ ID NO: 2367 - DNA, 15 bp, Homo sapiens
atgtcattgtggtta

SEQ ID NO: 2368 - DNA, 15 bp, Homo sapiens
aatgtcattgtggtt

SEQ ID NO: 2369 - DNA, 15 bp, Homo sapiens
caatgtcattgtggt

SEQ ID NO: 2370 - DNA, 15 bp, Homo sapiens
tcaatgtcattgtgg

SEQ ID NO: 2371 - DNA, 15 bp, Homo sapiens
ttcaatgtcattgtg

SEQ ID NO: 2372 - DNA, 15 bp, Homo sapiens
cttcaatgtcattgt

SEQ ID NO: 2373 - DNA, 15 bp, Homo sapiens
gcttcaatgtcattg

SEQ ID NO: 2374 - DNA, 15 bp, Homo sapiens
tgcttcaatgtcatt

SEQ ID NO: 2375 - DNA, 15 bp, Homo sapiens
gtgcttcaatgtcat

SEQ ID NO: 2376 - DNA, 15 bp, Homo sapiens
tgtgcttcaatgtca

SEQ ID NO: 2377 - DNA, 15 bp, Homo sapiens
ctgtgcttcaatgtc

SEQ ID NO: 2378 - DNA, 15 bp, Homo sapiens
cctgtgcttcaatgt

SEQ ID NO: 2379 - DNA, 15 bp, Homo sapiens
tcctgtgcttcaatg

SEQ ID NO: 2380 - DNA, 15 bp, Homo sapiens
atcctgtgcttcaat

SEQ ID NO: 2381 - DNA, 15 bp, Homo sapiens
gatcctgtgcttcaa

SEQ ID NO: 2382 - DNA, 15 bp, Homo sapiens
tgatcctgtgcttca

SEQ ID NO: 2383 - DNA, 15 bp, Homo sapiens
atgatcctgtgcttc

SEQ ID NO: 2384 - DNA, 15 bp, Homo sapiens
aatgatcctgtgctt

SEQ ID NO: 2385 - DNA, 15 bp, Homo sapiens
taatgatcctgtgct

SEQ ID NO: 2386 - DNA, 15 bp, Homo sapiens
ctaatgatcctgtgc

SEQ ID NO: 2387 - DNA, 15 bp, Homo sapiens
actaatgatcctgtg

SEQ ID NO: 2388 - DNA, 15 bp, Homo sapiens
gactaatgatcctgt

SEQ ID NO: 2389 - DNA, 15 bp, Homo sapiens
agactaatgatcctg

SEQ ID NO: 2390 - DNA, 15 bp, Homo sapiens
tagactaatgatcct

SEQ ID NO: 2391 - DNA, 15 bp, Homo sapiens
atagactaatgatcc

SEQ ID NO: 2392 - DNA, 15 bp, Homo sapiens
tatagactaatgatc

SEQ ID NO: 2393 - DNA, 15 bp, Homo sapiens
atatagactaatgat

SEQ ID NO: 2394 - DNA, 15 bp, Homo sapiens
aatatagactaatga

SEQ ID NO: 2395 - DNA, 15 bp, Homo sapiens
aaatatagactaatg

SEQ ID NO: 2396 - DNA, 15 bp, Homo sapiens
aaaatatagactaat

SEQ ID NO: 2397 - DNA, 15 bp, Homo sapiens
taaaatatagactaa

SEQ ID NO: 2398 - DNA, 15 bp, Homo sapiens
ataaaatatagacta

SEQ ID NO: 2399 - DNA, 15 bp, Homo sapiens
aataaaatatagact

SEQ ID NO: 2400 - DNA, 15 bp, Homo sapiens
aaataaaatatagac

SEQ ID NO: 2401 - DNA, 15 bp, Homo sapiens
aaaataaaatataga

SEQ ID NO: 2402 - DNA, 15 bp, Homo sapiens
taaaataaaatatag

SEQ ID NO: 2403 - DNA, 15 bp, Homo sapiens
ataaaataaaatata

SEQ ID NO: 2404 - DNA, 15 bp, Homo sapiens
aataaaataaaatat

SEQ ID NO: 2405 - DNA, 15 bp, Homo sapiens
taataaaataaaata

SEQ ID NO: 2406 - DNA, 15 bp, Homo sapiens
ataataaaataaaat

SEQ ID NO: 2407 - DNA, 15 bp, Homo sapiens
aataataaaataaaa

SEQ ID NO: 2408 - DNA, 15 bp, Homo sapiens
aaataataaaataaa

SEQ ID NO: 2409 - DNA, 15 bp, Homo sapiens
aaaataataaaataa

SEQ ID NO: 2410 - DNA, 15 bp, Homo sapiens
taaaataataaaata

SEQ ID NO: 2411 - DNA, 15 bp, Homo sapiens
ataaaataataaaat

SEQ ID NO: 2412 - DNA, 15 bp, Homo sapiens
aataaaataataaaa

SEQ ID NO: 2413 - DNA, 15 bp, Homo sapiens
aaataaaataataaa

SEQ ID NO: 2414 - DNA, 15 bp, Homo sapiens
taaataaaataataa

SEQ ID NO: 2415 - DNA, 15 bp, Homo sapiens
ataaataaaataata

SEQ ID NO: 2416 - DNA, 15 bp, Homo sapiens
aataaataaaataat

SEQ ID NO: 2417 - DNA, 15 bp, Homo sapiens
aaataaataaaataa

SEQ ID NO: 2418 - DNA, 15 bp, Homo sapiens
taaataaataaaata

SEQ ID NO: 2419 - DNA, 15 bp, Homo sapiens
ataaataaataaaat

SEQ ID NO: 2420 - DNA, 15 bp, Homo sapiens
aataaataaataaaa

SEQ ID NO: 2421 - DNA, 15 bp, Homo sapiens
aaataaataaataaa

SEQ ID NO: 2422 - DNA, 15 bp, Homo sapiens
taaataaataaataa

SEQ ID NO: 2423 - DNA, 15 bp, Homo sapiens
ataaataaataaata

SEQ ID NO: 2424 - DNA, 15 bp, Homo sapiens
aataaataaataaat

SEQ ID NO: 2425 - DNA, 15 bp, Homo sapiens
aaaataaataaataa

SEQ ID NO: 2426 - DNA, 15 bp, Homo sapiens
aaaaataaataaata

SEQ ID NO: 2427 - DNA, 15 bp, Homo sapiens
caaaaataaataaat

SEQ ID NO: 2428 - DNA, 15 bp, Homo sapiens
tcaaaaataaataaa

SEQ ID NO: 2429 - DNA, 15 bp, Homo sapiens
ctcaaaaataaataa

SEQ ID NO: 2430 - DNA, 15 bp, Homo sapiens
tctcaaaaataaata

SEQ ID NO: 2431 - DNA, 15 bp, Homo sapiens
atctcaaaaataaat

SEQ ID NO: 2432 - DNA, 15 bp, Homo sapiens
catctcaaaaataaa

SEQ ID NO: 2433 - DNA, 15 bp, Homo sapiens
ccatctcaaaaataa

SEQ ID NO: 2434 - DNA, 15 bp, Homo sapiens
tccatctcaaaaata

SEQ ID NO: 2435 - DNA, 15 bp, Homo sapiens
ctccatctcaaaaat

SEQ ID NO: 2436 - DNA, 15 bp, Homo sapiens
aagactccatctcaa

SEQ ID NO: 2437 - DNA, 15 bp, Homo sapiens
caagactccatctca

SEQ ID NO: 2438 - DNA, 15 bp, Homo sapiens
gcaagactccatctc

SEQ ID NO: 2439 - DNA, 15 bp, Homo sapiens
agcaagactccatct

SEQ ID NO: 2440 - DNA, 15 bp, Homo sapiens
gagcaagactccatc

SEQ ID NO: 2441 - DNA, 15 bp, Homo sapiens
agagcaagactccat

SEQ ID NO: 2442 - DNA, 15 bp, Homo sapiens
cagagcaagactcca

SEQ ID NO: 2443 - DNA, 15 bp, Homo sapiens
acagagcaagactcc

SEQ ID NO: 2444 - DNA, 15 bp, Homo sapiens
gacagagcaagactc

SEQ ID NO: 2445 - DNA, 15 bp, Homo sapiens
cgacagagcaagact

SEQ ID NO: 2446 - DNA, 15 bp, Homo sapiens
gcgacagagcaagac

SEQ ID NO: 2447 - DNA, 15 bp, Homo sapiens
ggcgacagagcaaga

SEQ ID NO: 2448 - DNA, 15 bp, Homo sapiens
gggcgacagagcaag

SEQ ID NO: 2449 - DNA, 15 bp, Homo sapiens
tgggcgacagagcaa

SEQ ID NO: 2450 - DNA, 15 bp, Homo sapiens
ctgggcgacagagca

SEQ ID NO: 2451 - DNA, 15 bp, Homo sapiens
cctgggcgacagagc

SEQ ID NO: 2452 - DNA, 15 bp, Homo sapiens
gcctgggcgacagag

SEQ ID NO: 2453 - DNA, 15 bp, Homo sapiens
agcctgggcgacaga

SEQ ID NO: 2454 - DNA, 15 bp, Homo sapiens
cagcctgggcgacag

SEQ ID NO: 2455 - DNA, 15 bp, Homo sapiens
ccagcctgggcgaca

SEQ ID NO: 2456 - DNA, 15 bp, Homo sapiens
tccagcctgggcgac

SEQ ID NO: 2457 - DNA, 15 bp, Homo sapiens
ctccagcctgggcga

SEQ ID NO: 2458 - DNA, 15 bp, Homo sapiens
actccagcctgggcg

SEQ ID NO: 2459 - DNA, 15 bp, Homo sapiens
cactccagcctgggc

SEQ ID NO: 2460 - DNA, 15 bp, Homo sapiens
gcactccagcctggg

SEQ ID NO: 2461 - DNA, 15 bp, Homo sapiens
tgcactccagcctgg

SEQ ID NO: 2462 - DNA, 15 bp, Homo sapiens
ctgcactccagcctg

SEQ ID NO: 2463 - DNA, 15 bp, Homo sapiens
actgcactccagcct

SEQ ID NO: 2464 - DNA, 15 bp, Homo sapiens
tgccactgcactcca

SEQ ID NO: 2465 - DNA, 15 bp, Homo sapiens
gtgccactgcactcc

SEQ ID NO: 2466 - DNA, 15 bp, Homo sapiens
tgtgccactgcactc

SEQ ID NO: 2467 - DNA, 15 bp, Homo sapiens
ttgtgccactgcact

SEQ ID NO: 2468 - DNA, 15 bp, Homo sapiens
attgtgccactgcac

SEQ ID NO: 2469 - DNA, 15 bp, Homo sapiens
gattgtgccactgca

SEQ ID NO: 2470 - DNA, 15 bp, Homo sapiens
agattgtgccactgc

SEQ ID NO: 2471 - DNA, 15 bp, Homo sapiens
gagattgtgccactg

SEQ ID NO: 2472 - DNA, 15 bp, Homo sapiens
cgagattgtgccact

SEQ ID NO: 2473 - DNA, 15 bp, Homo sapiens
ccgagattgtgccac

SEQ ID NO: 2474 - DNA, 15 bp, Homo sapiens
gccgagattgtgcca

SEQ ID NO: 2475 - DNA, 15 bp, Homo sapiens
agccgagattgtgcc

SEQ ID NO: 2476 - DNA, 15 bp, Homo sapiens
gagccgagattgtgc

SEQ ID NO: 2477 - DNA, 15 bp, Homo sapiens
tgagccgagattgtg

SEQ ID NO: 2478 - DNA, 15 bp, Homo sapiens
gtgagccgagattgt

SEQ ID NO: 2479 - DNA, 15 bp, Homo sapiens
agtgagccgagattg

SEQ ID NO: 2480 - DNA, 15 bp, Homo sapiens
cagtgagccgagatt

SEQ ID NO: 2481 - DNA, 15 bp, Homo sapiens
gcagtgagccgagat

SEQ ID NO: 2482 - DNA, 15 bp, Homo sapiens
tgcagtgagccgaga

SEQ ID NO: 2483 - DNA, 15 bp, Homo sapiens
ttgcagtgagccgag

SEQ ID NO: 2484 - DNA, 15 bp, Homo sapiens
cttgcagtgagccga

SEQ ID NO: 2485 - DNA, 15 bp, Homo sapiens
gcttgcagtgagccg

SEQ ID NO: 2486 - DNA, 15 bp, Homo sapiens
agcttgcagtgagcc

SEQ ID NO: 2487 - DNA, 15 bp, Homo sapiens
gagcttgcagtgagc

SEQ ID NO: 2488 - DNA, 15 bp, Homo sapiens
agagcttgcagtgag

SEQ ID NO: 2489 - DNA, 15 bp, Homo sapiens
cagagcttgcagtga

SEQ ID NO: 2490 - DNA, 15 bp, Homo sapiens
gcagagcttgcagtg

SEQ ID NO: 2491 - DNA, 15 bp, Homo sapiens
agcagagcttgcagt

SEQ ID NO: 2492 - DNA, 15 bp, Homo sapiens
aagcagagcttgcag

SEQ ID NO: 2493 - DNA, 15 bp, Homo sapiens
gaagcagagcttgca

SEQ ID NO: 2494 - DNA, 15 bp, Homo sapiens
ggaagcagagcttgc

SEQ ID NO: 2495 - DNA, 15 bp, Homo sapiens
gggaagcagagcttg

SEQ ID NO: 2496 - DNA, 15 bp, Homo sapiens
tgggaagcagagctt

SEQ ID NO: 2497 - DNA, 15 bp, Homo sapiens
ctgggaagcagagct

SEQ ID NO: 2498 - DNA, 15 bp, Homo sapiens
cctgggaagcagagc

SEQ ID NO: 2499 - DNA, 15 bp, Homo sapiens
acctgggaagcagag

SEQ ID NO: 2500 - DNA, 15 bp, Homo sapiens
aacctgggaagcaga

SEQ ID NO: 2501 - DNA, 15 bp, Homo sapiens
gaacctgggaagcag

SEQ ID NO: 2502 - DNA, 15 bp, Homo sapiens
tgaacctgggaagca

SEQ ID NO: 2503 - DNA, 15 bp, Homo sapiens
gtgaacctgggaagc

SEQ ID NO: 2504 - DNA, 15 bp, Homo sapiens
cgtgaacctgggaag

SEQ ID NO: 2505 - DNA, 15 bp, Homo sapiens
gcgtgaacctgggaa

SEQ ID NO: 2506 - DNA, 15 bp, Homo sapiens
ggcgtgaacctggga

SEQ ID NO: 2507 - DNA, 15 bp, Homo sapiens
tggcgtgaacctggg

SEQ ID NO: 2508 - DNA, 15 bp, Homo sapiens
atggcgtgaacctgg

SEQ ID NO: 2509 - DNA, 15 bp, Homo sapiens
aatggcgtgaacctg

SEQ ID NO: 2510 - DNA, 15 bp, Homo sapiens
gaatggcgtgaacct

SEQ ID NO: 2511 - DNA, 15 bp, Homo sapiens
agaatggcgtgaacc

SEQ ID NO: 2512 - DNA, 15 bp, Homo sapiens
gagaatggcgtgaac

SEQ ID NO: 2513 - DNA, 15 bp, Homo sapiens
ggagaatggcgtgaa

SEQ ID NO: 2514 - DNA, 15 bp, Homo sapiens
aggagaatggcgtga

SEQ ID NO: 2515 - DNA, 15 bp, Homo sapiens
caggagaatggcgtg

SEQ ID NO: 2516 - DNA, 15 bp, Homo sapiens
gcaggagaatggcgt

SEQ ID NO: 2517 - DNA, 15 bp, Homo sapiens
ggcaggagaatggcg

SEQ ID NO: 2518 - DNA, 15 bp, Homo sapiens
aggcaggagaatggc

SEQ ID NO: 2519 - DNA, 15 bp, Homo sapiens
gaggcaggagaatgg

SEQ ID NO: 2520 - DNA, 15 bp, Homo sapiens
tgaggcaggagaatg

SEQ ID NO: 2521 - DNA, 15 bp, Homo sapiens
ctgaggcaggagaat

SEQ ID NO: 2522 - DNA, 15 bp, Homo sapiens
gctgaggcaggagaa

SEQ ID NO: 2523 - DNA, 15 bp, Homo sapiens
ggctgaggcaggaga

SEQ ID NO: 2524 - DNA, 15 bp, Homo sapiens
aggctgaggcaggag

SEQ ID NO: 2525 - DNA, 15 bp, Homo sapiens
gaggctgaggcagga

SEQ ID NO: 2526 - DNA, 15 bp, Homo sapiens
ggaggctgaggcagg

SEQ ID NO: 2527 - DNA, 15 bp, Homo sapiens
gggaggctgaggcag

SEQ ID NO: 2528 - DNA, 15 bp, Homo sapiens
cgggaggctgaggca

SEQ ID NO: 2529 - DNA, 15 bp, Homo sapiens
tcgggaggctgaggc

SEQ ID NO: 2530 - DNA, 15 bp, Homo sapiens
ctcgggaggctgagg

SEQ ID NO: 2531 - DNA, 15 bp, Homo sapiens
actcgggaggctgag

SEQ ID NO: 2532 - DNA, 15 bp, Homo sapiens
tactcgggaggctga

SEQ ID NO: 2533 - DNA, 15 bp, Homo sapiens
ctactcgggaggctg

SEQ ID NO: 2534 - DNA, 15 bp, Homo sapiens
gctactcgggaggct

SEQ ID NO: 2535 - DNA, 15 bp, Homo sapiens
agctactcgggaggc

SEQ ID NO: 2536 - DNA, 15 bp, Homo sapiens
cagctactcgggagg

SEQ ID NO: 2537 - DNA, 15 bp, Homo sapiens
ccagctactcgggag

SEQ ID NO: 2538 - DNA, 15 bp, Homo sapiens
cccagctactcggga

SEQ ID NO: 2539 - DNA, 15 bp, Homo sapiens
tcccagctactcggg

SEQ ID NO: 2540 - DNA, 15 bp, Homo sapiens
gtcccagctactcgg

SEQ ID NO: 2541 - DNA, 15 bp, Homo sapiens
agtcccagctactcg

SEQ ID NO: 2542 - DNA, 15 bp, Homo sapiens
acctgtagtcccagc

SEQ ID NO: 2543 - DNA, 15 bp, Homo sapiens
cacctgtagtcccag

SEQ ID NO: 2544 - DNA, 15 bp, Homo sapiens
gcacctgtagtccca

SEQ ID NO: 2545 - DNA, 15 bp, Homo sapiens
ggcacctgtagtccc

SEQ ID NO: 2546 - DNA, 15 bp, Homo sapiens
gggcacctgtagtcc

SEQ ID NO: 2547 - DNA, 15 bp, Homo sapiens
tgggcacctgtagtc

SEQ ID NO: 2548 - DNA, 15 bp, Homo sapiens
gtgggcacctgtagt

SEQ ID NO: 2549 - DNA, 15 bp, Homo sapiens
ggtgggcacctgtag

SEQ ID NO: 2550 - DNA, 15 bp, Homo sapiens
tggtgggcacctgta

SEQ ID NO: 2551 - DNA, 15 bp, Homo sapiens
gtggtgggcacctgt

SEQ ID NO: 2552 - DNA, 15 bp, Homo sapiens
ggtggtgggcacctg

SEQ ID NO: 2553 - DNA, 15 bp, Homo sapiens
tggtggtgggcacct

SEQ ID NO: 2554 - DNA, 15 bp, Homo sapiens
gtggtggtgggcacc

SEQ ID NO: 2555 - DNA, 15 bp, Homo sapiens
tgtggtggtgggcac

SEQ ID NO: 2556 - DNA, 15 bp, Homo sapiens
gtgtggtggtgggca

SEQ ID NO: 2557 - DNA, 15 bp, Homo sapiens
ggtgtggtggtgggc

SEQ ID NO: 2558 - DNA, 15 bp, Homo sapiens
gggtgtggtggtggg

SEQ ID NO: 2559 - DNA, 15 bp, Homo sapiens
cgggtgtggtggtgg

SEQ ID NO: 2560 - DNA, 15 bp, Homo sapiens
ccgggtgtggtggtg

SEQ ID NO: 2561 - DNA, 15 bp, Homo sapiens
gccgggtgtggtggt

SEQ ID NO: 2562 - DNA, 15 bp, Homo sapiens
agccgggtgtggtgg

SEQ ID NO: 2563 - DNA, 15 bp, Homo sapiens
tagccgggtgtggtg

SEQ ID NO: 2564 - DNA, 15 bp, Homo sapiens
ttagccgggtgtggt

SEQ ID NO: 2565 - DNA, 15 bp, Homo sapiens
attagccgggtgtgg

SEQ ID NO: 2566 - DNA, 15 bp, Homo sapiens
aattagccgggtgtg

SEQ ID NO: 2567 - DNA, 15 bp, Homo sapiens
aaattagccgggtgt

SEQ ID NO: 2568 - DNA, 15 bp, Homo sapiens
aaaattagccgggtg

SEQ ID NO: 2569 - DNA, 15 bp, Homo sapiens
aaaaattagccgggt

SEQ ID NO: 2570 - DNA, 15 bp, Homo sapiens
aaaaaattagccggg

SEQ ID NO: 2571 - DNA, 15 bp, Homo sapiens
caaaaaattagccgg

SEQ ID NO: 2572 - DNA, 15 bp, Homo sapiens
acaaaaaattagccg

SEQ ID NO: 2573 - DNA, 15 bp, Homo sapiens
tacaaaaaattagcc

SEQ ID NO: 2574 - DNA, 15 bp, Homo sapiens
gtacaaaaaattagc

SEQ ID NO: 2575 - DNA, 15 bp, Homo sapiens
agtacaaaaaattag

SEQ ID NO: 2576 - DNA, 15 bp, Homo sapiens
aagtacaaaaaatta

SEQ ID NO: 2577 - DNA, 15 bp, Homo sapiens
aaagtacaaaaaatt

SEQ ID NO: 2578 - DNA, 15 bp, Homo sapiens
aaaagtacaaaaaat

SEQ ID NO: 2579 - DNA, 15 bp, Homo sapiens
taaaagtacaaaaaa

SEQ ID NO: 2580 - DNA, 15 bp, Homo sapiens
ctaaaagtacaaaaa

SEQ ID NO: 2581 - DNA, 15 bp, Homo sapiens
actaaaagtacaaaa

SEQ ID NO: 2582 - DNA, 15 bp, Homo sapiens
tactaaaagtacaaa

SEQ ID NO: 2583 - DNA, 15 bp, Homo sapiens
ctactaaaagtacaa

SEQ ID NO: 2584 - DNA, 15 bp, Homo sapiens
tctactaaaagtaca

SEQ ID NO: 2585 - DNA, 15 bp, Homo sapiens
ctctactaaaagtac

SEQ ID NO: 2586 - DNA, 15 bp, Homo sapiens
tctctactaaaagta

SEQ ID NO: 2587 - DNA, 15 bp, Homo sapiens
atctctactaaaagt

SEQ ID NO: 2588 - DNA, 15 bp, Homo sapiens
catctctactaaaag

SEQ ID NO: 2589 - DNA, 15 bp, Homo sapiens
ccatctctactaaaa

SEQ ID NO: 2590 - DNA, 15 bp, Homo sapiens
cccatctctactaaa

SEQ ID NO: 2591 - DNA, 15 bp, Homo sapiens
agtgaaaccccatct

SEQ ID NO: 2592 - DNA, 15 bp, Homo sapiens
cagtgaaaccccatc

SEQ ID NO: 2593 - DNA, 15 bp, Homo sapiens
acagtgaaaccccat

SEQ ID NO: 2594 - DNA, 15 bp, Homo sapiens
aacagtgaaacccca

SEQ ID NO: 2595 - DNA, 15 bp, Homo sapiens
aaacagtgaaacccc

SEQ ID NO: 2596 - DNA, 15 bp, Homo sapiens
aaaacagtgaaaccc

SEQ ID NO: 2597 - DNA, 15 bp, Homo sapiens
taaaacagtgaaacc

SEQ ID NO: 2598 - DNA, 15 bp, Homo sapiens
ctaaaacagtgaaac

SEQ ID NO: 2599 - DNA, 15 bp, Homo sapiens
gctaaaacagtgaaa

SEQ ID NO: 2600 - DNA, 15 bp, Homo sapiens
ggctaaaacagtgaa

SEQ ID NO: 2601 - DNA, 15 bp, Homo sapiens
tggctaaaacagtga

SEQ ID NO: 2602 - DNA, 15 bp, Homo sapiens
ctggctaaaacagtg

SEQ ID NO: 2603 - DNA, 15 bp, Homo sapiens
cctggctaaaacagt

SEQ ID NO: 2604 - DNA, 15 bp, Homo sapiens
tcctggctaaaacag

SEQ ID NO: 2605 - DNA, 15 bp, Homo sapiens
atcctggctaaaaca

SEQ ID NO: 2606 - DNA, 15 bp, Homo sapiens
catcctggctaaaac

SEQ ID NO: 2607 - DNA, 15 bp, Homo sapiens
ccatcctggctaaaa

SEQ ID NO: 2608 - DNA, 15 bp, Homo sapiens
accatcctggctaaa

SEQ ID NO: 2609 - DNA, 15 bp, Homo sapiens
gaccatcctggctaa

SEQ ID NO: 2610 - DNA, 15 bp, Homo sapiens
agaccatcctggcta

SEQ ID NO: 2611 - DNA, 15 bp, Homo sapiens
gagaccatcctggct

SEQ ID NO: 2612 - DNA, 15 bp, Homo sapiens
cgagaccatcctggc

SEQ ID NO: 2613 - DNA, 15 bp, Homo sapiens
tcgagaccatcctgg

SEQ ID NO: 2614 - DNA, 15 bp, Homo sapiens
atcgagaccatcctg

SEQ ID NO: 2615 - DNA, 15 bp, Homo sapiens
gatcgagaccatcct

SEQ ID NO: 2616 - DNA, 15 bp, Homo sapiens
agatcgagaccatcc

SEQ ID NO: 2617 - DNA, 15 bp, Homo sapiens
gagatcgagaccatc

SEQ ID NO: 2618 - DNA, 15 bp, Homo sapiens
ggagatcgagaccat

SEQ ID NO: 2619 - DNA, 15 bp, Homo sapiens
aggagatcgagacca

SEQ ID NO: 2620 - DNA, 15 bp, Homo sapiens
caggagatcgagacc

SEQ ID NO: 2621 - DNA, 15 bp, Homo sapiens
tcaggagatcgagac

SEQ ID NO: 2622 - DNA, 15 bp, Homo sapiens
gtcaggagatcgaga

SEQ ID NO: 2623 - DNA, 15 bp, Homo sapiens
ggtcaggagatcgag

SEQ ID NO: 2624 - DNA, 15 bp, Homo sapiens
aggtcaggagatcga

SEQ ID NO: 2625 - DNA, 15 bp, Homo sapiens
gaggtcaggagatcg

SEQ ID NO: 2626 - DNA, 15 bp, Homo sapiens
tgaggtcaggagatc

SEQ ID NO: 2627 - DNA, 15 bp, Homo sapiens
atgaggtcaggagat

SEQ ID NO: 2628 - DNA, 15 bp, Homo sapiens
catgaggtcaggaga

SEQ ID NO: 2629 - DNA, 15 bp, Homo sapiens
tcatgaggtcaggag

SEQ ID NO: 2630 - DNA, 15 bp, Homo sapiens
atcatgaggtcagga

SEQ ID NO: 2631 - DNA, 15 bp, Homo sapiens
gatcatgaggtcagg

SEQ ID NO: 2632 - DNA, 15 bp, Homo sapiens
ggatcatgaggtcag

SEQ ID NO: 2633 - DNA, 15 bp, Homo sapiens
tggatcatgaggtca

SEQ ID NO: 2634 - DNA, 15 bp, Homo sapiens
gtggatcatgaggtc

SEQ ID NO: 2635 - DNA, 15 bp, Homo sapiens
ggtggatcatgaggt

SEQ ID NO: 2636 - DNA, 15 bp, Homo sapiens
gggtggatcatgagg

SEQ ID NO: 2637 - DNA, 15 bp, Homo sapiens
cgggtggatcatgag

SEQ ID NO: 2638 - DNA, 15 bp, Homo sapiens
gcgggtggatcatga

SEQ ID NO: 2639 - DNA, 15 bp, Homo sapiens
ggcgggtggatcatg

SEQ ID NO: 2640 - DNA, 15 bp, Homo sapiens
aggcgggtggatcat

SEQ ID NO: 2641 - DNA, 15 bp, Homo sapiens
aaggcgggtggatca

SEQ ID NO: 2642 - DNA, 15 bp, Homo sapiens
caaggcgggtggatc

SEQ ID NO: 2643 - DNA, 15 bp, Homo sapiens
ccaaggcgggtggat

SEQ ID NO: 2644 - DNA, 15 bp, Homo sapiens
gccaaggcgggtgga

SEQ ID NO: 2645 - DNA, 15 bp, Homo sapiens
ggccaaggcgggtgg

SEQ ID NO: 2646 - DNA, 15 bp, Homo sapiens
aggccaaggcgggtg

SEQ ID NO: 2647 - DNA, 15 bp, Homo sapiens
gaggccaaggcgggt

SEQ ID NO: 2648 - DNA, 15 bp, Homo sapiens
ggaggccaaggcggg

SEQ ID NO: 2649 - DNA, 15 bp, Homo sapiens
gggaggccaaggcgg

SEQ ID NO: 2650 - DNA, 15 bp, Homo sapiens
tgggaggccaaggcg

SEQ ID NO: 2651 - DNA, 15 bp, Homo sapiens
ataatcccagcactt

SEQ ID NO: 2652 - DNA, 15 bp, Homo sapiens
tataatcccagcact

SEQ ID NO: 2653 - DNA, 15 bp, Homo sapiens
ctataatcccagcac

SEQ ID NO: 2654 - DNA, 15 bp, Homo sapiens
cctataatcccagca

SEQ ID NO: 2655 - DNA, 15 bp, Homo sapiens
acctataatcccagc

SEQ ID NO: 2656 - DNA, 15 bp, Homo sapiens
cacctataatcccag

SEQ ID NO: 2657 - DNA, 15 bp, Homo sapiens
acacctataatccca

SEQ ID NO: 2658 - DNA, 15 bp, Homo sapiens
tacacctataatccc

SEQ ID NO: 2659 - DNA, 15 bp, Homo sapiens
ttacacctataatcc

SEQ ID NO: 2660 - DNA, 15 bp, Homo sapiens
cttacacctataatc

SEQ ID NO: 2661 - DNA, 15 bp, Homo sapiens
acttacacctataat

SEQ ID NO: 2662 - DNA, 15 bp, Homo sapiens
gacttacacctataa

SEQ ID NO: 2663 - DNA, 15 bp, Homo sapiens
tgacttacacctata

SEQ ID NO: 2664 - DNA, 15 bp, Homo sapiens
gtgacttacacctat

SEQ ID NO: 2665 - DNA, 15 bp, Homo sapiens
ggtgacttacaccta

SEQ ID NO: 2666 - DNA, 15 bp, Homo sapiens
tggtgacttacacct

SEQ ID NO: 2667 - DNA, 15 bp, Homo sapiens
atggtgacttacacc

SEQ ID NO: 2668 - DNA, 15 bp, Homo sapiens
catggtgacttacac

SEQ ID NO: 2669 - DNA, 15 bp, Homo sapiens
gcatggtgacttaca

SEQ ID NO: 2670 - DNA, 15 bp, Homo sapiens
ggcatggtgacttac

SEQ ID NO: 2671 - DNA, 15 bp, Homo sapiens
gggcatggtgactta

SEQ ID NO: 2672 - DNA, 15 bp, Homo sapiens
tgggcatggtgactt

SEQ ID NO: 2673 - DNA, 15 bp, Homo sapiens
ctgggcatggtgact

SEQ ID NO: 2674 - DNA, 15 bp, Homo sapiens
gctgggcatggtgac

SEQ ID NO: 2675 - DNA, 15 bp, Homo sapiens
ggctgggcatggtga

SEQ ID NO: 2676 - DNA, 15 bp, Homo sapiens
gggctgggcatggtg

SEQ ID NO: 2677 - DNA, 15 bp, Homo sapiens
tgggctgggcatggt

SEQ ID NO: 2678 - DNA, 15 bp, Homo sapiens
atgggctgggcatgg

SEQ ID NO: 2679 - DNA, 15 bp, Homo sapiens
aatgggctgggcatg

SEQ ID NO: 2680 - DNA, 15 bp, Homo sapiens
taatgggctgggcat

SEQ ID NO: 2681 - DNA, 15 bp, Homo sapiens
ctaatgggctgggca

SEQ ID NO: 2682 - DNA, 15 bp, Homo sapiens
actaatgggctgggc

SEQ ID NO: 2683 - DNA, 15 bp, Homo sapiens
gactaatgggctggg

SEQ ID NO: 2684 - DNA, 15 bp, Homo sapiens
agactaatgggctgg

SEQ ID NO: 2685 - DNA, 15 bp, Homo sapiens
tagactaatgggctg

SEQ ID NO: 2686 - DNA, 15 bp, Homo sapiens
atagactaatgggct

SEQ ID NO: 2687 - DNA, 15 bp, Homo sapiens
tatagactaatgggc

SEQ ID NO: 2688 - DNA, 15 bp, Homo sapiens
atatagactaatggg

SEQ ID NO: 2689 - DNA, 15 bp, Homo sapiens
aatatagactaatgg

SEQ ID NO: 2690 - DNA, 15 bp, Homo sapiens
aaaaatatagactaa

SEQ ID NO: 2691 - DNA, 15 bp, Homo sapiens
taaaaatatagacta

SEQ ID NO: 2692 - DNA, 15 bp, Homo sapiens
ttaaaaatatagact

SEQ ID NO: 2693 - DNA, 15 bp, Homo sapiens
cttaaaaatatagac

SEQ ID NO: 2694 - DNA, 15 bp, Homo sapiens
acttaaaaatataga

SEQ ID NO: 2695 - DNA, 15 bp, Homo sapiens
tacttaaaaatatag

SEQ ID NO: 2696 - DNA, 15 bp, Homo sapiens
ttacttaaaaatata

SEQ ID NO: 2697 - DNA, 15 bp, Homo sapiens
tttacttaaaaatat

SEQ ID NO: 2698 - DNA, 15 bp, Homo sapiens
gtttacttaaaaata

SEQ ID NO: 2699 - DNA, 15 bp, Homo sapiens
tgtttacttaaaaat

SEQ ID NO: 2700 - DNA, 15 bp, Homo sapiens
atgtttacttaaaaa

SEQ ID NO: 2701 - DNA, 15 bp, Homo sapiens
tatgtttacttaaaa

SEQ ID NO: 2702 - DNA, 15 bp, Homo sapiens
gtatgtttacttaaa

SEQ ID NO: 2703 - DNA, 15 bp, Homo sapiens
ggtatgtttacttaa

SEQ ID NO: 2704 - DNA, 15 bp, Homo sapiens
tggtatgtttactta

SEQ ID NO: 2705 - DNA, 15 bp, Homo sapiens
ttggtatgtttactt

SEQ ID NO: 2706 - DNA, 15 bp, Homo sapiens
attggtatgtttact

SEQ ID NO: 2707 - DNA, 15 bp, Homo sapiens
aattggtatgtttac

SEQ ID NO: 2708 - DNA, 15 bp, Homo sapiens
taattggtatgttta

SEQ ID NO: 2709 - DNA, 15 bp, Homo sapiens
ttaattggtatgttt

SEQ ID NO: 2710 - DNA, 15 bp, Homo sapiens
cttaattggtatgtt

SEQ ID NO: 2711 - DNA, 15 bp, Homo sapiens
tcttaattggtatgt

SEQ ID NO: 2712 - DNA, 15 bp, Homo sapiens
ttcttaattggtatg

SEQ ID NO: 2713 - DNA, 15 bp, Homo sapiens
tttcttaattggtat

SEQ ID NO: 2714 - DNA, 15 bp, Homo sapiens
ctttcttaattggta

SEQ ID NO: 2715 - DNA, 15 bp, Homo sapiens
tctttcttaattggt

SEQ ID NO: 2716 - DNA, 15 bp, Homo sapiens
ttctttcttaattgg

SEQ ID NO: 2717 - DNA, 15 bp, Homo sapiens
cttctttcttaattg

SEQ ID NO: 2718 - DNA, 15 bp, Homo sapiens
gcttctttcttaatt

SEQ ID NO: 2719 - DNA, 15 bp, Homo sapiens
ggcttctttcttaat

SEQ ID NO: 2720 - DNA, 15 bp, Homo sapiens
tggcttctttcttaa

SEQ ID NO: 2721 - DNA, 15 bp, Homo sapiens
ttggcttctttctta

SEQ ID NO: 2722 - DNA, 15 bp, Homo sapiens
tttggcttctttctt

SEQ ID NO: 2723 - DNA, 15 bp, Homo sapiens
ttttggcttctttct

SEQ ID NO: 2724 - DNA, 15 bp, Homo sapiens
tttttggcttctttc

SEQ ID NO: 2725 - DNA, 15 bp, Homo sapiens
gtttttggcttcttt

SEQ ID NO: 2726 - DNA, 15 bp, Homo sapiens
ggtttttggcttctt

SEQ ID NO: 2727 - DNA, 15 bp, Homo sapiens
tggtttttggcttct

SEQ ID NO: 2728 - DNA, 15 bp, Homo sapiens
ttggtttttggcttc

SEQ ID NO: 2729 - DNA, 15 bp, Homo sapiens
tttggtttttggctt

SEQ ID NO: 2730 - DNA, 15 bp, Homo sapiens
ttttggtttttggct

SEQ ID NO: 2731 - DNA, 15 bp, Homo sapiens
attttggtttttggc

SEQ ID NO: 2732 - DNA, 15 bp, Homo sapiens
aattttggtttttgg

SEQ ID NO: 2733 - DNA, 15 bp, Homo sapiens
taattttggtttttg

SEQ ID NO: 2734 - DNA, 15 bp, Homo sapiens
ctaattttggttttt

SEQ ID NO: 2735 - DNA, 15 bp, Homo sapiens
gctaattttggtttt

SEQ ID NO: 2736 - DNA, 15 bp, Homo sapiens
ggctaattttggttt

SEQ ID NO: 2737 - DNA, 15 bp, Homo sapiens
tggctaattttggtt

SEQ ID NO: 2738 - DNA, 15 bp, Homo sapiens
ctggctaattttggt

SEQ ID NO: 2739 - DNA, 15 bp, Homo sapiens
cctggctaattttgg

SEQ ID NO: 2740 - DNA, 15 bp, Homo sapiens
acctggctaattttg

SEQ ID NO: 2741 - DNA, 15 bp, Homo sapiens
cacctggctaatttt

SEQ ID NO: 2742 - DNA, 15 bp, Homo sapiens
acacctggctaattt

SEQ ID NO: 2743 - DNA, 15 bp, Homo sapiens
cacacctggctaatt

SEQ ID NO: 2744 - DNA, 15 bp, Homo sapiens
ccacacctggctaat

SEQ ID NO: 2745 - DNA, 15 bp, Homo sapiens
accacacctggctaa

SEQ ID NO: 2746 - DNA, 15 bp, Homo sapiens
caccacacctggcta

SEQ ID NO: 2747 - DNA, 15 bp, Homo sapiens
ccaccacacctggct

SEQ ID NO: 2748 - DNA, 15 bp, Homo sapiens
gccaccacacctggc

SEQ ID NO: 2749 - DNA, 15 bp, Homo sapiens
tgccaccacacctgg

SEQ ID NO: 2750 - DNA, 15 bp, Homo sapiens
gtgccaccacacctg

SEQ ID NO: 2751 - DNA, 15 bp, Homo sapiens
cgtgccaccacacct

SEQ ID NO: 2752 - DNA, 15 bp, Homo sapiens
acgtgccaccacacc

SEQ ID NO: 2753 - DNA, 15 bp, Homo sapiens
cacgtgccaccacac

SEQ ID NO: 2754 - DNA, 15 bp, Homo sapiens
gcacgtgccaccaca

SEQ ID NO: 2755 - DNA, 15 bp, Homo sapiens
ggcacgtgccaccac

SEQ ID NO: 2756 - DNA, 15 bp, Homo sapiens
aggcacgtgccacca

SEQ ID NO: 2757 - DNA, 15 bp, Homo sapiens
caggcacgtgccacc

SEQ ID NO: 2758 - DNA, 15 bp, Homo sapiens
acaggcacgtgccac

SEQ ID NO: 2759 - DNA, 15 bp, Homo sapiens
tacaggcacgtgcca

SEQ ID NO: 2760 - DNA, 15 bp, Homo sapiens
ctacaggcacgtgcc

SEQ ID NO: 2761 - DNA, 15 bp, Homo sapiens
actacaggcacgtgc

SEQ ID NO: 2762 - DNA, 15 bp, Homo sapiens
gactacaggcacgtg

SEQ ID NO: 2763 - DNA, 15 bp, Homo sapiens
ggactacaggcacgt

SEQ ID NO: 2764 - DNA, 15 bp, Homo sapiens
gggactacaggcacg

SEQ ID NO: 2765 - DNA, 15 bp, Homo sapiens
tgggactacaggcac

SEQ ID NO: 2766 - DNA, 15 bp, Homo sapiens
ctgggactacaggca

SEQ ID NO: 2767 - DNA, 15 bp, Homo sapiens
aagtagctgggacta

SEQ ID NO: 2768 - DNA, 15 bp, Homo sapiens
caagtagctgggact

SEQ ID NO: 2769 - DNA, 15 bp, Homo sapiens
ccaagtagctgggac

SEQ ID NO: 2770 - DNA, 15 bp, Homo sapiens
cccaagtagctggga

SEQ ID NO: 2771 - DNA, 15 bp, Homo sapiens
tcccaagtagctggg

SEQ ID NO: 2772 - DNA, 15 bp, Homo sapiens
acctcagcctcccaa

SEQ ID NO: 2773 - DNA, 15 bp, Homo sapiens
cacctcagcctccca

SEQ ID NO: 2774 - DNA, 15 bp, Homo sapiens
acacctcagcctccc

SEQ ID NO: 2775 - DNA, 15 bp, Homo sapiens
cacacctcagcctcc

SEQ ID NO: 2776 - DNA, 15 bp, Homo sapiens
tcacacctcagcctc

SEQ ID NO: 2777 - DNA, 15 bp, Homo sapiens
ctcacacctcagcct

SEQ ID NO: 2778 - DNA, 15 bp, Homo sapiens
cctcacacctcagcc

SEQ ID NO: 2779 - DNA, 15 bp, Homo sapiens
tcctcacacctcagc

SEQ ID NO: 2780 - DNA, 15 bp, Homo sapiens
atcctcacacctcag

SEQ ID NO: 2781 - DNA, 15 bp, Homo sapiens
gatcctcacacctca

SEQ ID NO: 2782 - DNA, 15 bp, Homo sapiens
tgatcctcacacctc

SEQ ID NO: 2783 - DNA, 15 bp, Homo sapiens
gtgatcctcacacct

SEQ ID NO: 2784 - DNA, 15 bp, Homo sapiens
agtgatcctcacacc

SEQ ID NO: 2785 - DNA, 15 bp, Homo sapiens
aagtgatcctcacac

SEQ ID NO: 2786 - DNA, 15 bp, Homo sapiens
caagtgatcctcaca

SEQ ID NO: 2787 - DNA, 15 bp, Homo sapiens
tcaagtgatcctcac

SEQ ID NO: 2788 - DNA, 15 bp, Homo sapiens
ttcaagtgatcctca

SEQ ID NO: 2789 - DNA, 15 bp, Homo sapiens
gttcaagtgatcctc

SEQ ID NO: 2790 - DNA, 15 bp, Homo sapiens
agttcaagtgatcct

SEQ ID NO: 2791 - DNA, 15 bp, Homo sapiens
gagttcaagtgatcc

SEQ ID NO: 2792 - DNA, 15 bp, Homo sapiens
tgagttcaagtgatc

SEQ ID NO: 2793 - DNA, 15 bp, Homo sapiens
ctgagttcaagtgat

SEQ ID NO: 2794 - DNA, 15 bp, Homo sapiens
cctgagttcaagtga

SEQ ID NO: 2795 - DNA, 15 bp, Homo sapiens
tcctgagttcaagtg

SEQ ID NO: 2796 - DNA, 15 bp, Homo sapiens
ctcctgagttcaagt

SEQ ID NO: 2797 - DNA, 15 bp, Homo sapiens
cctcctgagttcaag

SEQ ID NO: 2798 - DNA, 15 bp, Homo sapiens
gcctcctgagttcaa

SEQ ID NO: 2799 - DNA, 15 bp, Homo sapiens
tgcctcctgagttca

SEQ ID NO: 2800 - DNA, 15 bp, Homo sapiens
ctgcctcctgagttc

SEQ ID NO: 2801 - DNA, 15 bp, Homo sapiens
tctgcctcctgagtt

SEQ ID NO: 2802 - DNA, 15 bp, Homo sapiens
ctctgcctcctgagt

SEQ ID NO: 2803 - DNA, 15 bp, Homo sapiens
cctctgcctcctgag

SEQ ID NO: 2804 - DNA, 15 bp, Homo sapiens
acctctgcctcctga

SEQ ID NO: 2805 - DNA, 15 bp, Homo sapiens
aacctctgcctcctg

SEQ ID NO: 2806 - DNA, 15 bp, Homo sapiens
caacctctgcctcct

SEQ ID NO: 2807 - DNA, 15 bp, Homo sapiens
gcaacctctgcctcc

SEQ ID NO: 2808 - DNA, 15 bp, Homo sapiens
tgcaacctctgcctc

SEQ ID NO: 2809 - DNA, 15 bp, Homo sapiens
ctgcaacctctgcct

SEQ ID NO: 2810 - DNA, 15 bp, Homo sapiens
actgcaacctctgcc

SEQ ID NO: 2811 - DNA, 15 bp, Homo sapiens
cactgcaacctctgc

SEQ ID NO: 2812 - DNA, 15 bp, Homo sapiens
tcactgcaacctctg

SEQ ID NO: 2813 - DNA, 15 bp, Homo sapiens
gtcactgcaacctct

SEQ ID NO: 2814 - DNA, 15 bp, Homo sapiens
ggtcactgcaacctc

SEQ ID NO: 2815 - DNA, 15 bp, Homo sapiens
gggtcactgcaacct

SEQ ID NO: 2816 - DNA, 15 bp, Homo sapiens
tgggtcactgcaacc

SEQ ID NO: 2817 - DNA, 15 bp, Homo sapiens
ttgggtcactgcaac

SEQ ID NO: 2818 - DNA, 15 bp, Homo sapiens
cttgggtcactgcaa

SEQ ID NO: 2819 - DNA, 15 bp, Homo sapiens
tcttgggtcactgca

SEQ ID NO: 2820 - DNA, 15 bp, Homo sapiens
atcttgggtcactgc

SEQ ID NO: 2821 - DNA, 15 bp, Homo sapiens
catcttgggtcactg

SEQ ID NO: 2822 - DNA, 15 bp, Homo sapiens
ccatcttgggtcact

SEQ ID NO: 2823 - DNA, 15 bp, Homo sapiens
accatcttgggtcac

SEQ ID NO: 2824 - DNA, 15 bp, Homo sapiens
caccatcttgggtca

SEQ ID NO: 2825 - DNA, 15 bp, Homo sapiens
gcaccatcttgggtc

SEQ ID NO: 2826 - DNA, 15 bp, Homo sapiens
ggcaccatcttgggt

SEQ ID NO: 2827 - DNA, 15 bp, Homo sapiens
tggcaccatcttggg

SEQ ID NO: 2828 - DNA, 15 bp, Homo sapiens
gtggcaccatcttgg

SEQ ID NO: 2829 - DNA, 15 bp, Homo sapiens
agtggcaccatcttg

SEQ ID NO: 2830 - DNA, 15 bp, Homo sapiens
cagtggcaccatctt

SEQ ID NO: 2831 - DNA, 15 bp, Homo sapiens
gcagtggcaccatct

SEQ ID NO: 2832 - DNA, 15 bp, Homo sapiens
tgcagtggcaccatc

SEQ ID NO: 2833 - DNA, 15 bp, Homo sapiens
gtgcagtggcaccat

SEQ ID NO: 2834 - DNA, 15 bp, Homo sapiens
agtgcagtggcacca

SEQ ID NO: 2835 - DNA, 15 bp, Homo sapiens
gagtgcagtggcacc

SEQ ID NO: 2836 - DNA, 15 bp, Homo sapiens
ggagtgcagtggcac

SEQ ID NO: 2837 - DNA, 15 bp, Homo sapiens
ctggagtgcagtggc

SEQ ID NO: 2838 - DNA, 15 bp, Homo sapiens
gctggagtgcagtgg

SEQ ID NO: 2839 - DNA, 15 bp, Homo sapiens
ggctggagtgcagtg

SEQ ID NO: 2840 - DNA, 15 bp, Homo sapiens
aggctggagtgcagt

SEQ ID NO: 2841 - DNA, 15 bp, Homo sapiens
caggctggagtgcag

SEQ ID NO: 2842 - DNA, 15 bp, Homo sapiens
acccaggctggagtg

SEQ ID NO: 2843 - DNA, 15 bp, Homo sapiens
cacccaggctggagt

SEQ ID NO: 2844 - DNA, 15 bp, Homo sapiens
tcacccaggctggag

SEQ ID NO: 2845 - DNA, 15 bp, Homo sapiens
gtcacccaggctgga

SEQ ID NO: 2846 - DNA, 15 bp, Homo sapiens
tgtcacccaggctgg

SEQ ID NO: 2847 - DNA, 15 bp, Homo sapiens
ctctgtcacccaggc

SEQ ID NO: 2848 - DNA, 15 bp, Homo sapiens
actctgtcacccagg

SEQ ID NO: 2849 - DNA, 15 bp, Homo sapiens
cactctgtcacccag

SEQ ID NO: 2850 - DNA, 15 bp, Homo sapiens
tcactctgtcaccca

SEQ ID NO: 2851 - DNA, 15 bp, Homo sapiens
ctcactctgtcaccc

SEQ ID NO: 2852 - DNA, 15 bp, Homo sapiens
tctcactctgtcacc

SEQ ID NO: 2853 - DNA, 15 bp, Homo sapiens
gtctcactctgtcac

SEQ ID NO: 2854 - DNA, 15 bp, Homo sapiens
ggtctcactctgtca

SEQ ID NO: 2855 - DNA, 15 bp, Homo sapiens
gggtctcactctgtc

SEQ ID NO: 2856 - DNA, 15 bp, Homo sapiens
agggtctcactctgt

SEQ ID NO: 2857 - DNA, 15 bp, Homo sapiens
cagggtctcactctg

SEQ ID NO: 2858 - DNA, 15 bp, Homo sapiens
acagggtctcactct

SEQ ID NO: 2859 - DNA, 15 bp, Homo sapiens
aacagggtctcactc

SEQ ID NO: 2860 - DNA, 15 bp, Homo sapiens
aaacagggtctcact

SEQ ID NO: 2861 - DNA, 15 bp, Homo sapiens
gaaacagggtctcac

SEQ ID NO: 2862 - DNA, 15 bp, Homo sapiens
ggaaacagggtctca

SEQ ID NO: 2863 - DNA, 15 bp, Homo sapiens
tggaaacagggtctc

SEQ ID NO: 2864 - DNA, 15 bp, Homo sapiens
gtggaaacagggtct

SEQ ID NO: 2865 - DNA, 15 bp, Homo sapiens
tgtggaaacagggtc

SEQ ID NO: 2866 - DNA, 15 bp, Homo sapiens
ttgtggaaacagggt

SEQ ID NO: 2867 - DNA, 15 bp, Homo sapiens
tttgtggaaacaggg

SEQ ID NO: 2868 - DNA, 15 bp, Homo sapiens
ttttgtggaaacagg

SEQ ID NO: 2869 - DNA, 15 bp, Homo sapiens
tttttgtggaaacag

SEQ ID NO: 2870 - DNA, 15 bp, Homo sapiens
ctttttgtggaaaca

SEQ ID NO: 2871 - DNA, 15 bp, Homo sapiens
tctttttgtggaaac

SEQ ID NO: 2872 - DNA, 15 bp, Homo sapiens
ttctttttgtggaaa

SEQ ID NO: 2873 - DNA, 15 bp, Homo sapiens
tttctttttgtggaa

SEQ ID NO: 2874 - DNA, 15 bp, Homo sapiens
ttttctttttgtgga

SEQ ID NO: 2875 - DNA, 15 bp, Homo sapiens
tttttctttttgtgg

SEQ ID NO: 2876 - DNA, 15 bp, Homo sapiens
ttttttctttttgtg

SEQ ID NO: 2877 - DNA, 15 bp, Homo sapiens
tttttttctttttgt

SEQ ID NO: 2878 - DNA, 15 bp, Homo sapiens
ttttttttctttttg

SEQ ID NO: 2879 - DNA, 15 bp, Homo sapiens
ttttttttttctttt

SEQ ID NO: 2880 - DNA, 15 bp, Homo sapiens
attttttttttcttt

SEQ ID NO: 2881 - DNA, 15 bp, Homo sapiens
tattttttttttctt

SEQ ID NO: 2882 - DNA, 15 bp, Homo sapiens
ctattttttttttct

SEQ ID NO: 2883 - DNA, 15 bp, Homo sapiens
gctattttttttttc

SEQ ID NO: 2884 - DNA, 15 bp, Homo sapiens
ggctatttttttttt

SEQ ID NO: 2885 - DNA, 15 bp, Homo sapiens
cggctattttttttt

SEQ ID NO: 2886 - DNA, 15 bp, Homo sapiens
acggctatttttttt

SEQ ID NO: 2887 - DNA, 15 bp, Homo sapiens
cacggctattttttt

SEQ ID NO: 2888 - DNA, 15 bp, Homo sapiens
gcacggctatttttt

SEQ ID NO: 2889 - DNA, 15 bp, Homo sapiens
ggcacggctattttt

SEQ ID NO: 2890 - DNA, 15 bp, Homo sapiens
aggcacggctatttt

SEQ ID NO: 2891 - DNA, 15 bp, Homo sapiens
caggcacggctattt

SEQ ID NO: 2892 - DNA, 15 bp, Homo sapiens
acaggcacggctatt

SEQ ID NO: 2893 - DNA, 15 bp, Homo sapiens
tacaggcacggctat

SEQ ID NO: 2894 - DNA, 15 bp, Homo sapiens
gtacaggcacggcta

SEQ ID NO: 2895 - DNA, 15 bp, Homo sapiens
agtacaggcacggct

SEQ ID NO: 2896 - DNA, 15 bp, Homo sapiens
aagtacaggcacggc

SEQ ID NO: 2897 - DNA, 15 bp, Homo sapiens
gaagtacaggcacgg

SEQ ID NO: 2898 - DNA, 15 bp, Homo sapiens
tgaagtacaggcacg

SEQ ID NO: 2899 - DNA, 15 bp, Homo sapiens
ctgaagtacaggcac

SEQ ID NO: 2900 - DNA, 15 bp, Homo sapiens
actgaagtacaggca

SEQ ID NO: 2901 - DNA, 15 bp, Homo sapiens
tactgaagtacaggc

SEQ ID NO: 2902 - DNA, 15 bp, Homo sapiens
gtactgaagtacagg

SEQ ID NO: 2903 - DNA, 15 bp, Homo sapiens
agtactgaagtacag

SEQ ID NO: 2904 - DNA, 15 bp, Homo sapiens
aagtactgaagtaca

SEQ ID NO: 2905 - DNA, 15 bp, Homo sapiens
taagtactgaagtac

SEQ ID NO: 2906 - DNA, 15 bp, Homo sapiens
gtaagtactgaagta

SEQ ID NO: 2907 - DNA, 15 bp, Homo sapiens
tgtaagtactgaagt

SEQ ID NO: 2908 - DNA, 15 bp, Homo sapiens
ttgtaagtactgaag

SEQ ID NO: 2909 - DNA, 15 bp, Homo sapiens
tttgtaagtactgaa

SEQ ID NO: 2910 - DNA, 15 bp, Homo sapiens
atttgtaagtactga

SEQ ID NO: 2911 - DNA, 15 bp, Homo sapiens
aatttgtaagtactg

SEQ ID NO: 2912 - DNA, 15 bp, Homo sapiens
aaatttgtaagtact

SEQ ID NO: 2913 - DNA, 15 bp, Homo sapiens
taaatttgtaagtac

SEQ ID NO: 2914 - DNA, 15 bp, Homo sapiens
ttaaatttgtaagta

SEQ ID NO: 2915 - DNA, 15 bp, Homo sapiens
gttaaatttgtaagt

SEQ ID NO: 2916 - DNA, 15 bp, Homo sapiens
agttaaatttgtaag

SEQ ID NO: 2917 - DNA, 15 bp, Homo sapiens
aagttaaatttgtaa

SEQ ID NO: 2918 - DNA, 15 bp, Homo sapiens
aaagttaaatttgta

SEQ ID NO: 2919 - DNA, 15 bp, Homo sapiens
taaagttaaatttgt

SEQ ID NO: 2920 - DNA, 15 bp, Homo sapiens
ctaaagttaaatttg

SEQ ID NO: 2921 - DNA, 15 bp, Homo sapiens
actaaagttaaattt

SEQ ID NO: 2922 - DNA, 15 bp, Homo sapiens
tactaaagttaaatt

SEQ ID NO: 2923 - DNA, 15 bp, Homo sapiens
atactaaagttaaat

SEQ ID NO: 2924 - DNA, 15 bp, Homo sapiens
tatactaaagttaaa

SEQ ID NO: 2925 - DNA, 15 bp, Homo sapiens
ctatactaaagttaa

SEQ ID NO: 2926 - DNA, 15 bp, Homo sapiens
tctatactaaagtta

SEQ ID NO: 2927 - DNA, 15 bp, Homo sapiens
atctatactaaagtt

SEQ ID NO: 2928 - DNA, 15 bp, Homo sapiens
catctatactaaagt

SEQ ID NO: 2929 - DNA, 15 bp, Homo sapiens
acatctatactaaag

SEQ ID NO: 2930 - DNA, 15 bp, Homo sapiens
tacatctatactaaa

SEQ ID NO: 2931 - DNA, 15 bp, Homo sapiens
gtacatctatactaa

SEQ ID NO: 2932 - DNA, 15 bp, Homo sapiens
tgtacatctatacta

SEQ ID NO: 2933 - DNA, 15 bp, Homo sapiens
ctgtacatctatact

SEQ ID NO: 2934 - DNA, 15 bp, Homo sapiens
actgtacatctatac

SEQ ID NO: 2935 - DNA, 15 bp, Homo sapiens
tactgtacatctata

SEQ ID NO: 2936 - DNA, 15 bp, Homo sapiens
ttactgtacatctat

SEQ ID NO: 2937 - DNA, 15 bp, Homo sapiens
attactgtacatcta

SEQ ID NO: 2938 - DNA, 15 bp, Homo sapiens
aattactgtacatct

SEQ ID NO: 2939 - DNA, 15 bp, Homo sapiens
aaattactgtacatc

SEQ ID NO: 2940 - DNA, 15 bp, Homo sapiens
taaattactgtacat

SEQ ID NO: 2941 - DNA, 15 bp, Homo sapiens
ataaattactgtaca

SEQ ID NO: 2942 - DNA, 15 bp, Homo sapiens
aataaattactgtac

SEQ ID NO: 2943 - DNA, 15 bp, Homo sapiens
gaataaattactgta

SEQ ID NO: 2944 - DNA, 15 bp, Homo sapiens
tgaataaattactgt

SEQ ID NO: 2945 - DNA, 15 bp, Homo sapiens
ttgaataaattactg

SEQ ID NO: 2946 - DNA, 15 bp, Homo sapiens
attgaataaattact

SEQ ID NO: 2947 - DNA, 15 bp, Homo sapiens
gattgaataaattac

SEQ ID NO: 2948 - DNA, 15 bp, Homo sapiens
tgattgaataaatta

SEQ ID NO: 2949 - DNA, 15 bp, Homo sapiens
atgattgaataaatt

SEQ ID NO: 2950 - DNA, 15 bp, Homo sapiens
aatgattgaataaat

SEQ ID NO: 2951 - DNA, 15 bp, Homo sapiens
aaatgattgaataaa

SEQ ID NO: 2952 - DNA, 15 bp, Homo sapiens
gaaatgattgaataa

SEQ ID NO: 2953 - DNA, 15 bp, Homo sapiens
ggaaatgattgaata

SEQ ID NO: 2954 - DNA, 15 bp, Homo sapiens
aggaaatgattgaat

SEQ ID NO: 2955 - DNA, 15 bp, Homo sapiens
aaggaaatgattgaa

SEQ ID NO: 2956 - DNA, 15 bp, Homo sapiens
taaggaaatgattga

SEQ ID NO: 2957 - DNA, 15 bp, Homo sapiens
gtaaggaaatgattg

SEQ ID NO: 2958 - DNA, 15 bp, Homo sapiens
agtaaggaaatgatt

SEQ ID NO: 2959 - DNA, 15 bp, Homo sapiens
gagtaaggaaatgat

SEQ ID NO: 2960 - DNA, 15 bp, Homo sapiens
tgagtaaggaaatga

SEQ ID NO: 2961 - DNA, 15 bp, Homo sapiens
atgagtaaggaaatg

SEQ ID NO: 2962 - DNA, 15 bp, Homo sapiens
tatgagtaaggaaat

SEQ ID NO: 2963 - DNA, 15 bp, Homo sapiens
ctatgagtaaggaaa

SEQ ID NO: 2964 - DNA, 15 bp, Homo sapiens
tctatgagtaaggaa

SEQ ID NO: 2965 - DNA, 15 bp, Homo sapiens
gtctatgagtaagga

SEQ ID NO: 2966 - DNA, 15 bp, Homo sapiens
tgtctatgagtaagg

SEQ ID NO: 2967 - DNA, 15 bp, Homo sapiens
ttgtctatgagtaag

SEQ ID NO: 2968 - DNA, 15 bp, Homo sapiens
attgtctatgagtaa

SEQ ID NO: 2969 - DNA, 15 bp, Homo sapiens
aattgtctatgagta

SEQ ID NO: 2970 - DNA, 15 bp, Homo sapiens
taattgtctatgagt

SEQ ID NO: 2971 - DNA, 15 bp, Homo sapiens
ctaattgtctatgag

SEQ ID NO: 2972 - DNA, 15 bp, Homo sapiens
cctaattgtctatga

SEQ ID NO: 2973 - DNA, 15 bp, Homo sapiens
tcctaattgtctatg

SEQ ID NO: 2974 - DNA, 15 bp, Homo sapiens
atcctaattgtctat

SEQ ID NO: 2975 - DNA, 15 bp, Homo sapiens
catcctaattgtcta

SEQ ID NO: 2976 - DNA, 15 bp, Homo sapiens
acatcctaattgtct

SEQ ID NO: 2977 - DNA, 15 bp, Homo sapiens
aacatcctaattgtc

SEQ ID NO: 2978 - DNA, 15 bp, Homo sapiens
caacatcctaattgt

SEQ ID NO: 2979 - DNA, 15 bp, Homo sapiens
gcaacatcctaattg

SEQ ID NO: 2980 - DNA, 15 bp, Homo sapiens
tgcaacatcctaatt

SEQ ID NO: 2981 - DNA, 15 bp, Homo sapiens
ttgcaacatcctaat

SEQ ID NO: 2982 - DNA, 15 bp, Homo sapiens
gttgcaacatcctaa

SEQ ID NO: 2983 - DNA, 15 bp, Homo sapiens
agttgcaacatccta

SEQ ID NO: 2984 - DNA, 15 bp, Homo sapiens
aagttgcaacatcct

SEQ ID NO: 2985 - DNA, 15 bp, Homo sapiens
aaagttgcaacatcc

SEQ ID NO: 2986 - DNA, 15 bp, Homo sapiens
aaaagttgcaacatc

SEQ ID NO: 2987 - DNA, 15 bp, Homo sapiens
caaaagttgcaacat

SEQ ID NO: 2988 - DNA, 15 bp, Homo sapiens
gcaaaagttgcaaca

SEQ ID NO: 2989 - DNA, 15 bp, Homo sapiens
ggcaaaagttgcaac

SEQ ID NO: 2990 - DNA, 15 bp, Homo sapiens
tggcaaaagttgcaa

SEQ ID NO: 2991 - DNA, 15 bp, Homo sapiens
gtggcaaaagttgca

SEQ ID NO: 2992 - DNA, 15 bp, Homo sapiens
agtggcaaaagttgc

SEQ ID NO: 2993 - DNA, 15 bp, Homo sapiens
tagtggcaaaagttg

SEQ ID NO: 2994 - DNA, 15 bp, Homo sapiens
gtagtggcaaaagtt

SEQ ID NO: 2995 - DNA, 15 bp, Homo sapiens
tgtagtggcaaaagt

SEQ ID NO: 2996 - DNA, 15 bp, Homo sapiens
ttgtagtggcaaaag

SEQ ID NO: 2997 - DNA, 15 bp, Homo sapiens
tttgtagtggcaaaa

SEQ ID NO: 2998 - DNA, 15 bp, Homo sapiens
gtttgtagtggcaaa

SEQ ID NO: 2999 - DNA, 15 bp, Homo sapiens
tgtttgtagtggcaa

SEQ ID NO: 3000 - DNA, 15 bp, Homo sapiens
ttgtttgtagtggca

SEQ ID NO: 3001 - DNA, 15 bp, Homo sapiens
attgtttgtagtggc

SEQ ID NO: 3002 - DNA, 15 bp, Homo sapiens
aattgtttgtagtgg

SEQ ID NO: 3003 - DNA, 15 bp, Homo sapiens
gaattgtttgtagtg

SEQ ID NO: 3004 - DNA, 15 bp, Homo sapiens
agaattgtttgtagt

SEQ ID NO: 3005 - DNA, 15 bp, Homo sapiens
cagaattgtttgtag

SEQ ID NO: 3006 - DNA, 15 bp, Homo sapiens
gcagaattgtttgta

SEQ ID NO: 3007 - DNA, 15 bp, Homo sapiens
cgcagaattgtttgt

SEQ ID NO: 3008 - DNA, 15 bp, Homo sapiens
tcgcagaattgtttg

SEQ ID NO: 3009 - DNA, 15 bp, Homo sapiens
atcgcagaattgttt

SEQ ID NO: 3010 - DNA, 15 bp, Homo sapiens
catcgcagaattgtt

SEQ ID NO: 3011 - DNA, 15 bp, Homo sapiens
acatcgcagaattgt

SEQ ID NO: 3012 - DNA, 15 bp, Homo sapiens
cacatcgcagaattg

SEQ ID NO: 3013 - DNA, 15 bp, Homo sapiens
ccacatcgcagaatt

SEQ ID NO: 3014 - DNA, 15 bp, Homo sapiens
tccacatcgcagaat

SEQ ID NO: 3015 - DNA, 15 bp, Homo sapiens
atccacatcgcagaa

SEQ ID NO: 3016 - DNA, 15 bp, Homo sapiens
aatccacatcgcaga

SEQ ID NO: 3017 - DNA, 15 bp, Homo sapiens
taatccacatcgcag

SEQ ID NO: 3018 - DNA, 15 bp, Homo sapiens
ataatccacatcgca

SEQ ID NO: 3019 - DNA, 15 bp, Homo sapiens
gataatccacatcgc

SEQ ID NO: 3020 - DNA, 15 bp, Homo sapiens
cgataatccacatcg

SEQ ID NO: 3021 - DNA, 15 bp, Homo sapiens
acgataatccacatc

SEQ ID NO: 3022 - DNA, 15 bp, Homo sapiens
tacgataatccacat

SEQ ID NO: 3023 - DNA, 15 bp, Homo sapiens
gtacgataatccaca

SEQ ID NO: 3024 - DNA, 15 bp, Homo sapiens
agtacgataatccac

SEQ ID NO: 3025 - DNA, 15 bp, Homo sapiens
aagtacgataatcca

SEQ ID NO: 3026 - DNA, 15 bp, Homo sapiens
taagtacgataatcc

SEQ ID NO: 3027 - DNA, 15 bp, Homo sapiens
ataagtacgataatc

SEQ ID NO: 3028 - DNA, 15 bp, Homo sapiens
aataagtacgataat

SEQ ID NO: 3029 - DNA, 15 bp, Homo sapiens
gaataagtacgataa

SEQ ID NO: 3030 - DNA, 15 bp, Homo sapiens
ggaataagtacgata

SEQ ID NO: 3031 - DNA, 15 bp, Homo sapiens
gggaataagtacgat

SEQ ID NO: 3032 - DNA, 15 bp, Homo sapiens
tgggaataagtacga

SEQ ID NO: 3033 - DNA, 15 bp, Homo sapiens
atgggaataagtacg

SEQ ID NO: 3034 - DNA, 15 bp, Homo sapiens
aatgggaataagtac

SEQ ID NO: 3035 - DNA, 15 bp, Homo sapiens
aaatgggaataagta

SEQ ID NO: 3036 - DNA, 15 bp, Homo sapiens
taaatgggaataagt

SEQ ID NO: 3037 - DNA, 15 bp, Homo sapiens
ataaatgggaataag

SEQ ID NO: 3038 - DNA, 15 bp, Homo sapiens
aataaatgggaataa

SEQ ID NO: 3039 - DNA, 15 bp, Homo sapiens
caataaatgggaata

SEQ ID NO: 3040 - DNA, 15 bp, Homo sapiens
ccaataaatgggaat

SEQ ID NO: 3041 - DNA, 15 bp, Homo sapiens
accaataaatgggaa

SEQ ID NO: 3042 - DNA, 15 bp, Homo sapiens
caccaataaatggga

SEQ ID NO: 3043 - DNA, 15 bp, Homo sapiens
gcaccaataaatggg

SEQ ID NO: 3044 - DNA, 15 bp, Homo sapiens
agcaccaataaatgg

SEQ ID NO: 3045 - DNA, 15 bp, Homo sapiens
aagcaccaataaatg

SEQ ID NO: 3046 - DNA, 15 bp, Homo sapiens
aaagcaccaataaat

SEQ ID NO: 3047 - DNA, 15 bp, Homo sapiens
gaaagcaccaataaa

SEQ ID NO: 3048 - DNA, 15 bp, Homo sapiens
tgaaagcaccaataa

SEQ ID NO: 3049 - DNA, 15 bp, Homo sapiens
atgaaagcaccaata

SEQ ID NO: 3050 - DNA, 15 bp, Homo sapiens
aatgaaagcaccaat

SEQ ID NO: 3051 - DNA, 15 bp, Homo sapiens
aaatgaaagcaccaa

SEQ ID NO: 3052 - DNA, 15 bp, Homo sapiens
gaaatgaaagcacca

SEQ ID NO: 3053 - DNA, 15 bp, Homo sapiens
agaaatgaaagcacc

SEQ ID NO: 3054 - DNA, 15 bp, Homo sapiens
tagaaatgaaagcac

SEQ ID NO: 3055 - DNA, 15 bp, Homo sapiens
atagaaatgaaagca

SEQ ID NO: 3056 - DNA, 15 bp, Homo sapiens
tatagaaatgaaagc

SEQ ID NO: 3057 - DNA, 15 bp, Homo sapiens
ttatagaaatgaaag

SEQ ID NO: 3058 - DNA, 15 bp, Homo sapiens
cttatagaaatgaaa

SEQ ID NO: 3059 - DNA, 15 bp, Homo sapiens
tcttatagaaatgaa

SEQ ID NO: 3060 - DNA, 15 bp, Homo sapiens
ttcttatagaaatga

SEQ ID NO: 3061 - DNA, 15 bp, Homo sapiens
attcttatagaaatg

SEQ ID NO: 3062 - DNA, 15 bp, Homo sapiens
cattcttatagaaat

SEQ ID NO: 3063 - DNA, 15 bp, Homo sapiens
ccattcttatagaaa

SEQ ID NO: 3064 - DNA, 15 bp, Homo sapiens
tccattcttatagaa

SEQ ID NO: 3065 - DNA, 15 bp, Homo sapiens
atccattcttataga

SEQ ID NO: 3066 - DNA, 15 bp, Homo sapiens
aatccattcttatag

SEQ ID NO: 3067 - DNA, 15 bp, Homo sapiens
aaatccattcttata

SEQ ID NO: 3068 - DNA, 15 bp, Homo sapiens
aaaatccattcttat

SEQ ID NO: 3069 - DNA, 15 bp, Homo sapiens
aaaaatccattctta

SEQ ID NO: 3070 - DNA, 15 bp, Homo sapiens
taaaaatccattctt

SEQ ID NO: 3071 - DNA, 15 bp, Homo sapiens
ttaaaaatccattct

SEQ ID NO: 3072 - DNA, 15 bp, Homo sapiens
tttaaaaatccattc

SEQ ID NO: 3073 - DNA, 15 bp, Homo sapiens
ctttaaaaatccatt

SEQ ID NO: 3074 - DNA, 15 bp, Homo sapiens
tctttaaaaatccat

SEQ ID NO: 3075 - DNA, 15 bp, Homo sapiens
atctttaaaaatcca

SEQ ID NO: 3076 - DNA, 15 bp, Homo sapiens
tatctttaaaaatcc

SEQ ID NO: 3077 - DNA, 15 bp, Homo sapiens
ctatctttaaaaatc

SEQ ID NO: 3078 - DNA, 15 bp, Homo sapiens
tctatctttaaaaat

SEQ ID NO: 3079 - DNA, 15 bp, Homo sapiens
ttctatctttaaaaa

SEQ ID NO: 3080 - DNA, 15 bp, Homo sapiens
attctatctttaaaa

SEQ ID NO: 3081 - DNA, 15 bp, Homo sapiens
aattctatctttaaa

SEQ ID NO: 3082 - DNA, 15 bp, Homo sapiens
gaattctatctttaa

SEQ ID NO: 3083 - DNA, 15 bp, Homo sapiens
ggaattctatcttta

SEQ ID NO: 3084 - DNA, 15 bp, Homo sapiens
aggaattctatcttt

SEQ ID NO: 3085 - DNA, 15 bp, Homo sapiens
aaggaattctatctt

SEQ ID NO: 3086 - DNA, 15 bp, Homo sapiens
caaggaattctatct

SEQ ID NO: 3087 - DNA, 15 bp, Homo sapiens
ccaaggaattctatc

SEQ ID NO: 3088 - DNA, 15 bp, Homo sapiens
cccaaggaattctat

SEQ ID NO: 3089 - DNA, 15 bp, Homo sapiens
tcccaaggaattcta

SEQ ID NO: 3090 - DNA, 15 bp, Homo sapiens
ttcccaaggaattct

SEQ ID NO: 3091 - DNA, 15 bp, Homo sapiens
attcccaaggaattc

SEQ ID NO: 3092 - DNA, 15 bp, Homo sapiens
tattcccaaggaatt

SEQ ID NO: 3093 - DNA, 15 bp, Homo sapiens
ctattcccaaggaat

SEQ ID NO: 3094 - DNA, 15 bp, Homo sapiens
actattcccaaggaa

SEQ ID NO: 3095 - DNA, 15 bp, Homo sapiens
aactattcccaagga

SEQ ID NO: 3096 - DNA, 15 bp, Homo sapiens
taactattcccaagg

SEQ ID NO: 3097 - DNA, 15 bp, Homo sapiens
ataactattcccaag

SEQ ID NO: 3098 - DNA, 15 bp, Homo sapiens
cataactattcccaa

SEQ ID NO: 3099 - DNA, 15 bp, Homo sapiens
acataactattccca

SEQ ID NO: 3100 - DNA, 15 bp, Homo sapiens
gacataactattccc

SEQ ID NO: 3101 - DNA, 15 bp, Homo sapiens
tgacataactattcc

SEQ ID NO: 3102 - DNA, 15 bp, Homo sapiens
ttgacataactattc

SEQ ID NO: 3103 - DNA, 15 bp, Homo sapiens
tttgacataactatt

SEQ ID NO: 3104 - DNA, 15 bp, Homo sapiens
ctttgacataactat

SEQ ID NO: 3105 - DNA, 15 bp, Homo sapiens
gctttgacataacta

SEQ ID NO: 3106 - DNA, 15 bp, Homo sapiens
ggctttgacataact

SEQ ID NO: 3107 - DNA, 15 bp, Homo sapiens
tggctttgacataac

SEQ ID NO: 3108 - DNA, 15 bp, Homo sapiens
ttggctttgacataa

SEQ ID NO: 3109 - DNA, 15 bp, Homo sapiens
tttggctttgacata

SEQ ID NO: 3110 - DNA, 15 bp, Homo sapiens
atttggctttgacat

SEQ ID NO: 3111 - DNA, 15 bp, Homo sapiens
tatttggctttgaca

SEQ ID NO: 3112 - DNA, 15 bp, Homo sapiens
atatttggctttgac

SEQ ID NO: 3113 - DNA, 15 bp, Homo sapiens
tatatttggctttga

SEQ ID NO: 3114 - DNA, 15 bp, Homo sapiens
ttatatttggctttg

SEQ ID NO: 3115 - DNA, 15 bp, Homo sapiens
attatatttggcttt

SEQ ID NO: 3116 - DNA, 15 bp, Homo sapiens
tattatatttggctt

SEQ ID NO: 3117 - DNA, 15 bp, Homo sapiens
atattatatttggct

SEQ ID NO: 3118 - DNA, 15 bp, Homo sapiens
tatattatatttggc

SEQ ID NO: 3119 - DNA, 15 bp, Homo sapiens
ctatattatatttgg

SEQ ID NO: 3120 - DNA, 15 bp, Homo sapiens
tctatattatatttg

SEQ ID NO: 3121 - DNA, 15 bp, Homo sapiens
ctctatattatattt

SEQ ID NO: 3122 - DNA, 15 bp, Homo sapiens
tctctatattatatt

SEQ ID NO: 3123 - DNA, 15 bp, Homo sapiens
gtctctatattatat

SEQ ID NO: 3124 - DNA, 15 bp, Homo sapiens
tgtctctatattata

SEQ ID NO: 3125 - DNA, 15 bp, Homo sapiens
ttgtctctatattat

SEQ ID NO: 3126 - DNA, 15 bp, Homo sapiens
tttgtctctatatta

SEQ ID NO: 3127 - DNA, 15 bp, Homo sapiens
atttgtctctatatt

SEQ ID NO: 3128 - DNA, 15 bp, Homo sapiens
gatttgtctctatat

SEQ ID NO: 3129 - DNA, 15 bp, Homo sapiens
agatttgtctctata

SEQ ID NO: 3130 - DNA, 15 bp, Homo sapiens
gagatttgtctctat

SEQ ID NO: 3131 - DNA, 15 bp, Homo sapiens
agagatttgtctcta

SEQ ID NO: 3132 - DNA, 15 bp, Homo sapiens
tagagatttgtctct

SEQ ID NO: 3133 - DNA, 15 bp, Homo sapiens
ttagagatttgtctc

SEQ ID NO: 3134 - DNA, 15 bp, Homo sapiens
tttagagatttgtct

SEQ ID NO: 3135 - DNA, 15 bp, Homo sapiens
ttttagagatttgtc

SEQ ID NO: 3136 - DNA, 15 bp, Homo sapiens
tttttagagatttgt

SEQ ID NO: 3137 - DNA, 15 bp, Homo sapiens
gtttttagagatttg

SEQ ID NO: 3138 - DNA, 15 bp, Homo sapiens
tgtttttagagattt

SEQ ID NO: 3139 - DNA, 15 bp, Homo sapiens
atgtttttagagatt

SEQ ID NO: 3140 - DNA, 15 bp, Homo sapiens
aatgtttttagagat

SEQ ID NO: 3141 - DNA, 15 bp, Homo sapiens
aaatgtttttagaga

SEQ ID NO: 3142 - DNA, 15 bp, Homo sapiens
aaaatgtttttagag

SEQ ID NO: 3143 - DNA, 15 bp, Homo sapiens
taaaatgtttttaga

SEQ ID NO: 3144 - DNA, 15 bp, Homo sapiens
ataaaatgtttttag

SEQ ID NO: 3145 - DNA, 15 bp, Homo sapiens
aataaaatgttttta

SEQ ID NO: 3146 - DNA, 15 bp, Homo sapiens
aaataaaatgttttt

SEQ ID NO: 3147 - DNA, 15 bp, Homo sapiens
caaataaaatgtttt

SEQ ID NO: 3148 - DNA, 15 bp, Homo sapiens
ccaaataaaatgttt

SEQ ID NO: 3149 - DNA, 15 bp, Homo sapiens
accaaataaaatgtt

SEQ ID NO: 3150 - DNA, 15 bp, Homo sapiens
taccaaataaaatgt

SEQ ID NO: 3151 - DNA, 15 bp, Homo sapiens
ttaccaaataaaatg

SEQ ID NO: 3152 - DNA, 15 bp, Homo sapiens
cttaccaaataaaat

SEQ ID NO: 3153 - DNA, 15 bp, Homo sapiens
gcttaccaaataaaa

SEQ ID NO: 3154 - DNA, 15 bp, Homo sapiens
tgcttaccaaataaa

SEQ ID NO: 3155 - DNA, 15 bp, Homo sapiens
ttgcttaccaaataa

SEQ ID NO: 3156 - DNA, 15 bp, Homo sapiens
cttgcttaccaaata

SEQ ID NO: 3157 - DNA, 15 bp, Homo sapiens
tcttgcttaccaaat

SEQ ID NO: 3158 - DNA, 15 bp, Homo sapiens
ctcttgcttaccaaa

SEQ ID NO: 3159 - DNA, 15 bp, Homo sapiens
gctcttgcttaccaa

SEQ ID NO: 3160 - DNA, 15 bp, Homo sapiens
agctcttgcttacca

SEQ ID NO: 3161 - DNA, 15 bp, Homo sapiens
cagctcttgcttacc

SEQ ID NO: 3162 - DNA, 15 bp, Homo sapiens
gcagctcttgcttac

SEQ ID NO: 3163 - DNA, 15 bp, Homo sapiens
tgcagctcttgctta

SEQ ID NO: 3164 - DNA, 15 bp, Homo sapiens
ttgcagctcttgctt

SEQ ID NO: 3165 - DNA, 15 bp, Homo sapiens
attgcagctcttgct

SEQ ID NO: 3166 - DNA, 15 bp, Homo sapiens
aattgcagctcttgc

SEQ ID NO: 3167 - DNA, 15 bp, Homo sapiens
gaattgcagctcttg

SEQ ID NO: 3168 - DNA, 15 bp, Homo sapiens
tgaattgcagctctt

SEQ ID NO: 3169 - DNA, 15 bp, Homo sapiens
atgaattgcagctct

SEQ ID NO: 3170 - DNA, 15 bp, Homo sapiens
catgaattgcagctc

SEQ ID NO: 3171 - DNA, 15 bp, Homo sapiens
ccatgaattgcagct

SEQ ID NO: 3172 - DNA, 15 bp, Homo sapiens
gccatgaattgcagc

SEQ ID NO: 3173 - DNA, 15 bp, Homo sapiens
tgccatgaattgcag

SEQ ID NO: 3174 - DNA, 15 bp, Homo sapiens
atgccatgaattgca

SEQ ID NO: 3175 - DNA, 15 bp, Homo sapiens
tatgccatgaattgc

SEQ ID NO: 3176 - DNA, 15 bp, Homo sapiens
gtatgccatgaattg

SEQ ID NO: 3177 - DNA, 15 bp, Homo sapiens
tgtatgccatgaatt

SEQ ID NO: 3178 - DNA, 15 bp, Homo sapiens
gtgtatgccatgaat

SEQ ID NO: 3179 - DNA, 15 bp, Homo sapiens
tgtgtatgccatgaa

SEQ ID NO: 3180 - DNA, 15 bp, Homo sapiens
gtgtgtatgccatga

SEQ ID NO: 3181 - DNA, 15 bp, Homo sapiens
tgtgtgtatgccatg

SEQ ID NO: 3182 - DNA, 15 bp, Homo sapiens
ctgtgtgtatgccat

SEQ ID NO: 3183 - DNA, 15 bp, Homo sapiens
tctgtgtgtatgcca

SEQ ID NO: 3184 - DNA, 15 bp, Homo sapiens
gtctgtgtgtatgcc

SEQ ID NO: 3185 - DNA, 15 bp, Homo sapiens
ggtctgtgtgtatgc

SEQ ID NO: 3186 - DNA, 15 bp, Homo sapiens
tggtctgtgtgtatg

SEQ ID NO: 3187 - DNA, 15 bp, Homo sapiens
ctggtctgtgtgtat

SEQ ID NO: 3188 - DNA, 15 bp, Homo sapiens
cctggtctgtgtgta

SEQ ID NO: 3189 - DNA, 15 bp, Homo sapiens
gcctggtctgtgtgt

SEQ ID NO: 3190 - DNA, 15 bp, Homo sapiens
agcctggtctgtgtg

SEQ ID NO: 3191 - DNA, 15 bp, Homo sapiens
cagcctggtctgtgt

SEQ ID NO: 3192 - DNA, 15 bp, Homo sapiens
tcagcctggtctgtg

SEQ ID NO: 3193 - DNA, 15 bp, Homo sapiens
atcagcctggtctgt

SEQ ID NO: 3194 - DNA, 15 bp, Homo sapiens
gatcagcctggtctg

SEQ ID NO: 3195 - DNA, 15 bp, Homo sapiens
tgatcagcctggtct

SEQ ID NO: 3196 - DNA, 15 bp, Homo sapiens
atgatcagcctggtc

SEQ ID NO: 3197 - DNA, 15 bp, Homo sapiens
aatgatcagcctggt

SEQ ID NO: 3198 - DNA, 15 bp, Homo sapiens
caatgatcagcctgg

SEQ ID NO: 3199 - DNA, 15 bp, Homo sapiens
ccaatgatcagcctg

SEQ ID NO: 3200 - DNA, 15 bp, Homo sapiens
accaatgatcagcct

SEQ ID NO: 3201 - DNA, 15 bp, Homo sapiens
taccaatgatcagcc

SEQ ID NO: 3202 - DNA, 15 bp, Homo sapiens
ataccaatgatcagc

SEQ ID NO: 3203 - DNA, 15 bp, Homo sapiens
cataccaatgatcag

SEQ ID NO: 3204 - DNA, 15 bp, Homo sapiens
tcataccaatgatca

SEQ ID NO: 3205 - DNA, 15 bp, Homo sapiens
atcataccaatgatc

SEQ ID NO: 3206 - DNA, 15 bp, Homo sapiens
gatcataccaatgat

SEQ ID NO: 3207 - DNA, 15 bp, Homo sapiens
tgatcataccaatga

SEQ ID NO: 3208 - DNA, 15 bp, Homo sapiens
ctgatcataccaatg

SEQ ID NO: 3209 - DNA, 15 bp, Homo sapiens
cctgatcataccaat

SEQ ID NO: 3210 - DNA, 15 bp, Homo sapiens
tcctgatcataccaa

SEQ ID NO: 3211 - DNA, 15 bp, Homo sapiens
ctcctgatcatacca

SEQ ID NO: 3212 - DNA, 15 bp, Homo sapiens
tctcctgatcatacc

SEQ ID NO: 3213 - DNA, 15 bp, Homo sapiens
ttctcctgatcatac

SEQ ID NO: 3214 - DNA, 15 bp, Homo sapiens
attctcctgatcata

SEQ ID NO: 3215 - DNA, 15 bp, Homo sapiens
tattctcctgatcat

SEQ ID NO: 3216 - DNA, 15 bp, Homo sapiens
ttattctcctgatca

SEQ ID NO: 3217 - DNA, 15 bp, Homo sapiens
tttattctcctgatc

SEQ ID NO: 3218 - DNA, 15 bp, Homo sapiens
ctttattctcctgat

SEQ ID NO: 3219 - DNA, 15 bp, Homo sapiens
cctttattctcctga

SEQ ID NO: 3220 - DNA, 15 bp, Homo sapiens
ccctttattctcctg

SEQ ID NO: 3221 - DNA, 15 bp, Homo sapiens
tccctttattctcct

SEQ ID NO: 3222 - DNA, 15 bp, Homo sapiens
ttccctttattctcc

SEQ ID NO: 3223 - DNA, 15 bp, Homo sapiens
cttccctttattctc

SEQ ID NO: 3224 - DNA, 15 bp, Homo sapiens
ccttccctttattct

SEQ ID NO: 3225 - DNA, 15 bp, Homo sapiens
accttccctttattc

SEQ ID NO: 3226 - DNA, 15 bp, Homo sapiens
aaccttccctttatt

SEQ ID NO: 3227 - DNA, 15 bp, Homo sapiens
caaccttccctttat

SEQ ID NO: 3228 - DNA, 15 bp, Homo sapiens
gcaaccttcccttta

SEQ ID NO: 3229 - DNA, 15 bp, Homo sapiens
cgcaaccttcccttt

SEQ ID NO: 3230 - DNA, 15 bp, Homo sapiens
ccgcaaccttccctt

SEQ ID NO: 3231 - DNA, 15 bp, Homo sapiens
gccgcaaccttccct

SEQ ID NO: 3232 - DNA, 15 bp, Homo sapiens
ggccgcaaccttccc

SEQ ID NO: 3233 - DNA, 15 bp, Homo sapiens
tggccgcaaccttcc

SEQ ID NO: 3234 - DNA, 15 bp, Homo sapiens
ctggccgcaaccttc

SEQ ID NO: 3235 - DNA, 15 bp, Homo sapiens
cctggccgcaacctt

SEQ ID NO: 3236 - DNA, 15 bp, Homo sapiens
acctggccgcaacct

SEQ ID NO: 3237 - DNA, 15 bp, Homo sapiens
cacctggccgcaacc

SEQ ID NO: 3238 - DNA, 15 bp, Homo sapiens
acacctggccgcaac

SEQ ID NO: 3239 - DNA, 15 bp, Homo sapiens
cacacctggccgcaa

SEQ ID NO: 3240 - DNA, 15 bp, Homo sapiens
tcacacctggccgca

SEQ ID NO: 3241 - DNA, 15 bp, Homo sapiens
atcacacctggccgc

SEQ ID NO: 3242 - DNA, 15 bp, Homo sapiens
tatcacacctggccg

SEQ ID NO: 3243 - DNA, 15 bp, Homo sapiens
ctatcacacctggcc

SEQ ID NO: 3244 - DNA, 15 bp, Homo sapiens
gctatcacacctggc

SEQ ID NO: 3245 - DNA, 15 bp, Homo sapiens
agctatcacacctgg

SEQ ID NO: 3246 - DNA, 15 bp, Homo sapiens
gagctatcacacctg

SEQ ID NO: 3247 - DNA, 15 bp, Homo sapiens
tgagctatcacacct

SEQ ID NO: 3248 - DNA, 15 bp, Homo sapiens
atgagctatcacacc

SEQ ID NO: 3249 - DNA, 15 bp, Homo sapiens
catgagctatcacac

SEQ ID NO: 3250 - DNA, 15 bp, Homo sapiens
gcatgagctatcaca

SEQ ID NO: 3251 - DNA, 15 bp, Homo sapiens
ggcatgagctatcac

SEQ ID NO: 3252 - DNA, 15 bp, Homo sapiens
aggcatgagctatca

SEQ ID NO: 3253 - DNA, 15 bp, Homo sapiens
caggcatgagctatc

SEQ ID NO: 3254 - DNA, 15 bp, Homo sapiens
acaggcatgagctat

SEQ ID NO: 3255 - DNA, 15 bp, Homo sapiens
tacaggcatgagcta

SEQ ID NO: 3256 - DNA, 15 bp, Homo sapiens
ttacaggcatgagct

SEQ ID NO: 3257 - DNA, 15 bp, Homo sapiens
gggattacaggcatg

SEQ ID NO: 3258 - DNA, 15 bp, Homo sapiens
tgggattacaggcat

SEQ ID NO: 3259 - DNA, 15 bp, Homo sapiens
ctgggattacaggca

SEQ ID NO: 3260 - DNA, 15 bp, Homo sapiens
gctgggattacaggc

SEQ ID NO: 3261 - DNA, 15 bp, Homo sapiens
tgctgggattacagg

SEQ ID NO: 3262 - DNA, 15 bp, Homo sapiens
gtgctgggattacag

SEQ ID NO: 3263 - DNA, 15 bp, Homo sapiens
agtgctgggattaca

SEQ ID NO: 3264 - DNA, 15 bp, Homo sapiens
aagtgctgggattac

SEQ ID NO: 3265 - DNA, 15 bp, Homo sapiens
aaagtgctgggatta

SEQ ID NO: 3266 - DNA, 15 bp, Homo sapiens
caaagtgctgggatt

SEQ ID NO: 3267 - DNA, 15 bp, Homo sapiens
ccaaagtgctgggat

SEQ ID NO: 3268 - DNA, 15 bp, Homo sapiens
cccaaagtgctggga

SEQ ID NO: 3269 - DNA, 15 bp, Homo sapiens
tcccaaagtgctggg

SEQ ID NO: 3270 - DNA, 15 bp, Homo sapiens
gcctcggcctcccaa

SEQ ID NO: 3271 - DNA, 15 bp, Homo sapiens
cgcctcggcctccca

SEQ ID NO: 3272 - DNA, 15 bp, Homo sapiens
ccgcctcggcctccc

SEQ ID NO: 3273 - DNA, 15 bp, Homo sapiens
cccgcctcggcctcc

SEQ ID NO: 3274 - DNA, 15 bp, Homo sapiens
gcccgcctcggcctc

SEQ ID NO: 3275 - DNA, 15 bp, Homo sapiens
tgcccgcctcggcct

SEQ ID NO: 3276 - DNA, 15 bp, Homo sapiens
ctgcccgcctcggcc

SEQ ID NO: 3277 - DNA, 15 bp, Homo sapiens
tctgcccgcctcggc

SEQ ID NO: 3278 - DNA, 15 bp, Homo sapiens
atctgcccgcctcgg

SEQ ID NO: 3279 - DNA, 15 bp, Homo sapiens
gatctgcccgcctcg

SEQ ID NO: 3280 - DNA, 15 bp, Homo sapiens
tgatctgcccgcctc

SEQ ID NO: 3281 - DNA, 15 bp, Homo sapiens
gtgatctgcccgcct

SEQ ID NO: 3282 - DNA, 15 bp, Homo sapiens
ggtgatctgcccgcc

SEQ ID NO: 3283 - DNA, 15 bp, Homo sapiens
aggtgatctgcccgc

SEQ ID NO: 3284 - DNA, 15 bp, Homo sapiens
caggtgatctgcccg

SEQ ID NO: 3285 - DNA, 15 bp, Homo sapiens
aaactcctgacctca

SEQ ID NO: 3286 - DNA, 15 bp, Homo sapiens
caaactcctgacctc

SEQ ID NO: 3287 - DNA, 15 bp, Homo sapiens
tcaaactcctgacct

SEQ ID NO: 3288 - DNA, 15 bp, Homo sapiens
ctcaaactcctgacc

SEQ ID NO: 3289 - DNA, 15 bp, Homo sapiens
tctcaaactcctgac

SEQ ID NO: 3290 - DNA, 15 bp, Homo sapiens
gtctcaaactcctga

SEQ ID NO: 3291 - DNA, 15 bp, Homo sapiens
ggtctcaaactcctg

SEQ ID NO: 3292 - DNA, 15 bp, Homo sapiens
tggtctcaaactcct

SEQ ID NO: 3293 - DNA, 15 bp, Homo sapiens
ctggtctcaaactcc

SEQ ID NO: 3294 - DNA, 15 bp, Homo sapiens
gctggtctcaaactc

SEQ ID NO: 3295 - DNA, 15 bp, Homo sapiens
ggctggtctcaaact

SEQ ID NO: 3296 - DNA, 15 bp, Homo sapiens
aggctggtctcaaac

SEQ ID NO: 3297 - DNA, 15 bp, Homo sapiens
caggctggtctcaaa

SEQ ID NO: 3298 - DNA, 15 bp, Homo sapiens
tcaggctggtctcaa

SEQ ID NO: 3299 - DNA, 15 bp, Homo sapiens
gtcaggctggtctca

SEQ ID NO: 3300 - DNA, 15 bp, Homo sapiens
ggtcaggctggtctc

SEQ ID NO: 3301 - DNA, 15 bp, Homo sapiens
tggtcaggctggtct

SEQ ID NO: 3302 - DNA, 15 bp, Homo sapiens
ttggtcaggctggtc

SEQ ID NO: 3303 - DNA, 15 bp, Homo sapiens
gttggtcaggctggt

SEQ ID NO: 3304 - DNA, 15 bp, Homo sapiens
tgttggtcaggctgg

SEQ ID NO: 3305 - DNA, 15 bp, Homo sapiens
atgttggtcaggctg

SEQ ID NO: 3306 - DNA, 15 bp, Homo sapiens
catgttggtcaggct

SEQ ID NO: 3307 - DNA, 15 bp, Homo sapiens
ccatgttggtcaggc

SEQ ID NO: 3308 - DNA, 15 bp, Homo sapiens
tccatgttggtcagg

SEQ ID NO: 3309 - DNA, 15 bp, Homo sapiens
ctccatgttggtcag

SEQ ID NO: 3310 - DNA, 15 bp, Homo sapiens
tctccatgttggtca

SEQ ID NO: 3311 - DNA, 15 bp, Homo sapiens
ttctccatgttggtc

SEQ ID NO: 3312 - DNA, 15 bp, Homo sapiens
tttctccatgttggt

SEQ ID NO: 3313 - DNA, 15 bp, Homo sapiens
gtttctccatgttgg

SEQ ID NO: 3314 - DNA, 15 bp, Homo sapiens
agtttctccatgttg

SEQ ID NO: 3315 - DNA, 15 bp, Homo sapiens
gagtttctccatgtt

SEQ ID NO: 3316 - DNA, 15 bp, Homo sapiens
ggagtttctccatgt

SEQ ID NO: 3317 - DNA, 15 bp, Homo sapiens
cggagtttctccatg

SEQ ID NO: 3318 - DNA, 15 bp, Homo sapiens
acggagtttctccat

SEQ ID NO: 3319 - DNA, 15 bp, Homo sapiens
gacggagtttctcca

SEQ ID NO: 3320 - DNA, 15 bp, Homo sapiens
agacggagtttctcc

SEQ ID NO: 3321 - DNA, 15 bp, Homo sapiens
gagacggagtttctc

SEQ ID NO: 3322 - DNA, 15 bp, Homo sapiens
agagacggagtttct

SEQ ID NO: 3323 - DNA, 15 bp, Homo sapiens
tagagacggagtttc

SEQ ID NO: 3324 - DNA, 15 bp, Homo sapiens
gtagagacggagttt

SEQ ID NO: 3325 - DNA, 15 bp, Homo sapiens
agtagagacggagtt

SEQ ID NO: 3326 - DNA, 15 bp, Homo sapiens
tagtagagacggagt

SEQ ID NO: 3327 - DNA, 15 bp, Homo sapiens
ttagtagagacggag

SEQ ID NO: 3328 - DNA, 15 bp, Homo sapiens
tttagtagagacgga

SEQ ID NO: 3329 - DNA, 15 bp, Homo sapiens
attttgtatttttag

SEQ ID NO: 3330 - DNA, 15 bp, Homo sapiens
aattttgtattttta

SEQ ID NO: 3331 - DNA, 15 bp, Homo sapiens
taattttgtattttt

SEQ ID NO: 3332 - DNA, 15 bp, Homo sapiens
ctaattttgtatttt

SEQ ID NO: 3333 - DNA, 15 bp, Homo sapiens
actaattttgtattt

SEQ ID NO: 3334 - DNA, 15 bp, Homo sapiens
aactaattttgtatt

SEQ ID NO: 3335 - DNA, 15 bp, Homo sapiens
caactaattttgtat

SEQ ID NO: 3336 - DNA, 15 bp, Homo sapiens
ccaactaattttgta

SEQ ID NO: 3337 - DNA, 15 bp, Homo sapiens
cccaactaattttgt

SEQ ID NO: 3338 - DNA, 15 bp, Homo sapiens
gcccaactaattttg

SEQ ID NO: 3339 - DNA, 15 bp, Homo sapiens
tgcccaactaatttt

SEQ ID NO: 3340 - DNA, 15 bp, Homo sapiens
atgcccaactaattt

SEQ ID NO: 3341 - DNA, 15 bp, Homo sapiens
tatgcccaactaatt

SEQ ID NO: 3342 - DNA, 15 bp, Homo sapiens
ctatgcccaactaat

SEQ ID NO: 3343 - DNA, 15 bp, Homo sapiens
actatgcccaactaa

SEQ ID NO: 3344 - DNA, 15 bp, Homo sapiens
cactatgcccaacta

SEQ ID NO: 3345 - DNA, 15 bp, Homo sapiens
ccactatgcccaact

SEQ ID NO: 3346 - DNA, 15 bp, Homo sapiens
gccactatgcccaac

SEQ ID NO: 3347 - DNA, 15 bp, Homo sapiens
cgccactatgcccaa

SEQ ID NO: 3348 - DNA, 15 bp, Homo sapiens
gcgccactatgccca

SEQ ID NO: 3349 - DNA, 15 bp, Homo sapiens
tgcgccactatgccc

SEQ ID NO: 3350 - DNA, 15 bp, Homo sapiens
atgcgccactatgcc

SEQ ID NO: 3351 - DNA, 15 bp, Homo sapiens
catgcgccactatgc

SEQ ID NO: 3352 - DNA, 15 bp, Homo sapiens
gcatgcgccactatg

SEQ ID NO: 3353 - DNA, 15 bp, Homo sapiens
ggcatgcgccactat

SEQ ID NO: 3354 - DNA, 15 bp, Homo sapiens
aggcatgcgccacta

SEQ ID NO: 3355 - DNA, 15 bp, Homo sapiens
caggcatgcgccact

SEQ ID NO: 3356 - DNA, 15 bp, Homo sapiens
tcaggcatgcgccac

SEQ ID NO: 3357 - DNA, 15 bp, Homo sapiens
ttcaggcatgcgcca

SEQ ID NO: 3358 - DNA, 15 bp, Homo sapiens
attcaggcatgcgcc

SEQ ID NO: 3359 - DNA, 15 bp, Homo sapiens
gattcaggcatgcgc

SEQ ID NO: 3360 - DNA, 15 bp, Homo sapiens
ggattcaggcatgcg

SEQ ID NO: 3361 - DNA, 15 bp, Homo sapiens
gggattcaggcatgc

SEQ ID NO: 3362 - DNA, 15 bp, Homo sapiens
tgggattcaggcatg

SEQ ID NO: 3363 - DNA, 15 bp, Homo sapiens
ctgggattcaggcat

SEQ ID NO: 3364 - DNA, 15 bp, Homo sapiens
gctgggattcaggca

SEQ ID NO: 3365 - DNA, 15 bp, Homo sapiens
agctgggattcaggc

SEQ ID NO: 3366 - DNA, 15 bp, Homo sapiens
tagctgggattcagg

SEQ ID NO: 3367 - DNA, 15 bp, Homo sapiens
gtagctgggattcag

SEQ ID NO: 3368 - DNA, 15 bp, Homo sapiens
agtagctgggattca

SEQ ID NO: 3369 - DNA, 15 bp, Homo sapiens
gagtagctgggattc

SEQ ID NO: 3370 - DNA, 15 bp, Homo sapiens
tgagtagctgggatt

SEQ ID NO: 3371 - DNA, 15 bp, Homo sapiens
ctgagtagctgggat

SEQ ID NO: 3372 - DNA, 15 bp, Homo sapiens
cctgagtagctggga

SEQ ID NO: 3373 - DNA, 15 bp, Homo sapiens
tcctgagtagctggg

SEQ ID NO: 3374 - DNA, 15 bp, Homo sapiens
ctcctgagtagctgg

SEQ ID NO: 3375 - DNA, 15 bp, Homo sapiens
cctcctgagtagctg

SEQ ID NO: 3376 - DNA, 15 bp, Homo sapiens
gcctcctgagtagct

SEQ ID NO: 3377 - DNA, 15 bp, Homo sapiens
agcctcctgagtagc

SEQ ID NO: 3378 - DNA, 15 bp, Homo sapiens
cagcctcctgagtag

SEQ ID NO: 3379 - DNA, 15 bp, Homo sapiens
tcagcctcctgagta

SEQ ID NO: 3380 - DNA, 15 bp, Homo sapiens
gtcagcctcctgagt

SEQ ID NO: 3381 - DNA, 15 bp, Homo sapiens
tgtcagcctcctgag

SEQ ID NO: 3382 - DNA, 15 bp, Homo sapiens
gtgtcagcctcctga

SEQ ID NO: 3383 - DNA, 15 bp, Homo sapiens
tgtgtcagcctcctg

SEQ ID NO: 3384 - DNA, 15 bp, Homo sapiens
ctgtgtcagcctcct

SEQ ID NO: 3385 - DNA, 15 bp, Homo sapiens
cctgtgtcagcctcc

SEQ ID NO: 3386 - DNA, 15 bp, Homo sapiens
tcctgtgtcagcctc

SEQ ID NO: 3387 - DNA, 15 bp, Homo sapiens
ctcctgtgtcagcct

SEQ ID NO: 3388 - DNA, 15 bp, Homo sapiens
tctcctgtgtcagcc

SEQ ID NO: 3389 - DNA, 15 bp, Homo sapiens
ttctcctgtgtcagc

SEQ ID NO: 3390 - DNA, 15 bp, Homo sapiens
tttctcctgtgtcag

SEQ ID NO: 3391 - DNA, 15 bp, Homo sapiens
atttctcctgtgtca

SEQ ID NO: 3392 - DNA, 15 bp, Homo sapiens
catttctcctgtgtc

SEQ ID NO: 3393 - DNA, 15 bp, Homo sapiens
gcatttctcctgtgt

SEQ ID NO: 3394 - DNA, 15 bp, Homo sapiens
agcatttctcctgtg

SEQ ID NO: 3395 - DNA, 15 bp, Homo sapiens
aagcatttctcctgt

SEQ ID NO: 3396 - DNA, 15 bp, Homo sapiens
caagcatttctcctg

SEQ ID NO: 3397 - DNA, 15 bp, Homo sapiens
tcaagcatttctcct

SEQ ID NO: 3398 - DNA, 15 bp, Homo sapiens
ttcaagcatttctcc

SEQ ID NO: 3399 - DNA, 15 bp, Homo sapiens
gttcaagcatttctc

SEQ ID NO: 3400 - DNA, 15 bp, Homo sapiens
ggttcaagcatttct

SEQ ID NO: 3401 - DNA, 15 bp, Homo sapiens
gggttcaagcatttc

SEQ ID NO: 3402 - DNA, 15 bp, Homo sapiens
cgggttcaagcattt

SEQ ID NO: 3403 - DNA, 15 bp, Homo sapiens
ccgggttcaagcatt

SEQ ID NO: 3404 - DNA, 15 bp, Homo sapiens
cccgggttcaagcat

SEQ ID NO: 3405 - DNA, 15 bp, Homo sapiens
tcccgggttcaagca

SEQ ID NO: 3406 - DNA, 15 bp, Homo sapiens
ctcccgggttcaagc

SEQ ID NO: 3407 - DNA, 15 bp, Homo sapiens
cctcccgggttcaag

SEQ ID NO: 3408 - DNA, 15 bp, Homo sapiens
acctcccgggttcaa

SEQ ID NO: 3409 - DNA, 15 bp, Homo sapiens
cacctcccgggttca

SEQ ID NO: 3410 - DNA, 15 bp, Homo sapiens
tcacctcccgggttc

SEQ ID NO: 3411 - DNA, 15 bp, Homo sapiens
ttcacctcccgggtt

SEQ ID NO: 3412 - DNA, 15 bp, Homo sapiens
cttcacctcccgggt

SEQ ID NO: 3413 - DNA, 15 bp, Homo sapiens
ccttcacctcccggg

SEQ ID NO: 3414 - DNA, 15 bp, Homo sapiens
accttcacctcccgg

SEQ ID NO: 3415 - DNA, 15 bp, Homo sapiens
aaccttcacctcccg

SEQ ID NO: 3416 - DNA, 15 bp, Homo sapiens
caaccttcacctccc

SEQ ID NO: 3417 - DNA, 15 bp, Homo sapiens
gcaaccttcacctcc

SEQ ID NO: 3418 - DNA, 15 bp, Homo sapiens
tgcaaccttcacctc

SEQ ID NO: 3419 - DNA, 15 bp, Homo sapiens
ctgcaaccttcacct

SEQ ID NO: 3420 - DNA, 15 bp, Homo sapiens
actgcaaccttcacc

SEQ ID NO: 3421 - DNA, 15 bp, Homo sapiens
cactgcaaccttcac

SEQ ID NO: 3422 - DNA, 15 bp, Homo sapiens
tcactgcaaccttca

SEQ ID NO: 3423 - DNA, 15 bp, Homo sapiens
ctcactgcaaccttc

SEQ ID NO: 3424 - DNA, 15 bp, Homo sapiens
cgatctcggctcact

SEQ ID NO: 3425 - DNA, 15 bp, Homo sapiens
gcgatctcggctcac

SEQ ID NO: 3426 - DNA, 15 bp, Homo sapiens
cgcgatctcggctca

SEQ ID NO: 3427 - DNA, 15 bp, Homo sapiens
gcgcgatctcggctc

SEQ ID NO: 3428 - DNA, 15 bp, Homo sapiens
ggcgcgatctcggct

SEQ ID NO: 3429 - DNA, 15 bp, Homo sapiens
tggcgcgatctcggc

SEQ ID NO: 3430 - DNA, 15 bp, Homo sapiens
atggcgcgatctcgg

SEQ ID NO: 3431 - DNA, 15 bp, Homo sapiens
aatggcgcgatctcg

SEQ ID NO: 3432 - DNA, 15 bp, Homo sapiens
caatggcgcgatctc

SEQ ID NO: 3433 - DNA, 15 bp, Homo sapiens
gcaatggcgcgatct

SEQ ID NO: 3434 - DNA, 15 bp, Homo sapiens
tgcaatggcgcgatc

SEQ ID NO: 3435 - DNA, 15 bp, Homo sapiens
gtgcaatggcgcgat

SEQ ID NO: 3436 - DNA, 15 bp, Homo sapiens
agtgcaatggcgcga

SEQ ID NO: 3437 - DNA, 15 bp, Homo sapiens
gagtgcaatggcgcg

SEQ ID NO: 3438 - DNA, 15 bp, Homo sapiens
ggagtgcaatggcgc

SEQ ID NO: 3439 - DNA, 15 bp, Homo sapiens
tggagtgcaatggcg

SEQ ID NO: 3440 - DNA, 15 bp, Homo sapiens
ctggagtgcaatggc

SEQ ID NO: 3441 - DNA, 15 bp, Homo sapiens
gctggagtgcaatgg

SEQ ID NO: 3442 - DNA, 15 bp, Homo sapiens
ggctggagtgcaatg

SEQ ID NO: 3443 - DNA, 15 bp, Homo sapiens
aggctggagtgcaat

SEQ ID NO: 3444 - DNA, 15 bp, Homo sapiens
caggctggagtgcaa

SEQ ID NO: 3445 - DNA, 15 bp, Homo sapiens
tgcccaggctggagt

SEQ ID NO: 3446 - DNA, 15 bp, Homo sapiens
ttgcccaggctggag

SEQ ID NO: 3447 - DNA, 15 bp, Homo sapiens
gttgcccaggctgga

SEQ ID NO: 3448 - DNA, 15 bp, Homo sapiens
ttgttgcccaggctg

SEQ ID NO: 3449 - DNA, 15 bp, Homo sapiens
cttgttgcccaggct

SEQ ID NO: 3450 - DNA, 15 bp, Homo sapiens
tcttgttgcccaggc

SEQ ID NO: 3451 - DNA, 15 bp, Homo sapiens
ctcttgttgcccagg

SEQ ID NO: 3452 - DNA, 15 bp, Homo sapiens
gctcttgttgcccag

SEQ ID NO: 3453 - DNA, 15 bp, Homo sapiens
tgctcttgttgccca

SEQ ID NO: 3454 - DNA, 15 bp, Homo sapiens
ttgctcttgttgccc

SEQ ID NO: 3455 - DNA, 15 bp, Homo sapiens
tttgctcttgttgcc

SEQ ID NO: 3456 - DNA, 15 bp, Homo sapiens
ttttgctcttgttgc

SEQ ID NO: 3457 - DNA, 15 bp, Homo sapiens
attttgctcttgttg

SEQ ID NO: 3458 - DNA, 15 bp, Homo sapiens
aattttgctcttgtt

SEQ ID NO: 3459 - DNA, 15 bp, Homo sapiens
gaattttgctcttgt

SEQ ID NO: 3460 - DNA, 15 bp, Homo sapiens
ggaattttgctcttg

SEQ ID NO: 3461 - DNA, 15 bp, Homo sapiens
tggaattttgctctt

SEQ ID NO: 3462 - DNA, 15 bp, Homo sapiens
atggaattttgctct

SEQ ID NO: 3463 - DNA, 15 bp, Homo sapiens
gatggaattttgctc

SEQ ID NO: 3464 - DNA, 15 bp, Homo sapiens
agatggaattttgct

SEQ ID NO: 3465 - DNA, 15 bp, Homo sapiens
gagatggaattttgc

SEQ ID NO: 3466 - DNA, 15 bp, Homo sapiens
tgagatggaattttg

SEQ ID NO: 3467 - DNA, 15 bp, Homo sapiens
ttgagatggaatttt

SEQ ID NO: 3468 - DNA, 15 bp, Homo sapiens
tttgagatggaattt

SEQ ID NO: 3469 - DNA, 15 bp, Homo sapiens
ttttgagatggaatt

SEQ ID NO: 3470 - DNA, 15 bp, Homo sapiens
tttttgagatggaat

SEQ ID NO: 3471 - DNA, 15 bp, Homo sapiens
ttttttgagatggaa

SEQ ID NO: 3472 - DNA, 15 bp, Homo sapiens
tttttttgagatgga

SEQ ID NO: 3473 - DNA, 15 bp, Homo sapiens
ttttttttgagatgg

SEQ ID NO: 3474 - DNA, 15 bp, Homo sapiens
tttttttttgagatg

SEQ ID NO: 3475 - DNA, 15 bp, Homo sapiens
ttttttttttgagat

SEQ ID NO: 3476 - DNA, 15 bp, Homo sapiens
ctctttttttttttt

SEQ ID NO: 3477 - DNA, 15 bp, Homo sapiens
tctcttttttttttt

SEQ ID NO: 3478 - DNA, 15 bp, Homo sapiens
ttctctttttttttt

SEQ ID NO: 3479 - DNA, 15 bp, Homo sapiens
cttctcttttttttt

SEQ ID NO: 3480 - DNA, 15 bp, Homo sapiens
ccttctctttttttt

SEQ ID NO: 3481 - DNA, 15 bp, Homo sapiens
accttctcttttttt

SEQ ID NO: 3482 - DNA, 15 bp, Homo sapiens
aaccttctctttttt

SEQ ID NO: 3483 - DNA, 15 bp, Homo sapiens
gaaccttctcttttt

SEQ ID NO: 3484 - DNA, 15 bp, Homo sapiens
ggaaccttctctttt

SEQ ID NO: 3485 - DNA, 15 bp, Homo sapiens
cggaaccttctcttt

SEQ ID NO: 3486 - DNA, 15 bp, Homo sapiens
ccggaaccttctctt

SEQ ID NO: 3487 - DNA, 15 bp, Homo sapiens
cccggaaccttctct

SEQ ID NO: 3488 - DNA, 15 bp, Homo sapiens
acccggaaccttctc

SEQ ID NO: 3489 - DNA, 15 bp, Homo sapiens
aacccggaaccttct

SEQ ID NO: 3490 - DNA, 15 bp, Homo sapiens
aaacccggaaccttc

SEQ ID NO: 3491 - DNA, 15 bp, Homo sapiens
aaaacccggaacctt

SEQ ID NO: 3492 - DNA, 15 bp, Homo sapiens
taaaacccggaacct

SEQ ID NO: 3493 - DNA, 15 bp, Homo sapiens
ataaaacccggaacc

SEQ ID NO: 3494 - DNA, 15 bp, Homo sapiens
cataaaacccggaac

SEQ ID NO: 3495 - DNA, 15 bp, Homo sapiens
tcataaaacccggaa

SEQ ID NO: 3496 - DNA, 15 bp, Homo sapiens
ctcataaaacccgga

SEQ ID NO: 3497 - DNA, 15 bp, Homo sapiens
tctcataaaacccgg

SEQ ID NO: 3498 - DNA, 15 bp, Homo sapiens
ttctcataaaacccg

SEQ ID NO: 3499 - DNA, 15 bp, Homo sapiens
tttctcataaaaccc

SEQ ID NO: 3500 - DNA, 15 bp, Homo sapiens
ctttctcataaaacc

SEQ ID NO: 3501 - DNA, 15 bp, Homo sapiens
tctttctcataaaac

SEQ ID NO: 3502 - DNA, 15 bp, Homo sapiens
ttctttctcataaaa

SEQ ID NO: 3503 - DNA, 15 bp, Homo sapiens
gttctttctcataaa

SEQ ID NO: 3504 - DNA, 15 bp, Homo sapiens
tgttctttctcataa

SEQ ID NO: 3505 - DNA, 15 bp, Homo sapiens
ctgttctttctcata

SEQ ID NO: 3506 - DNA, 15 bp, Homo sapiens
actgttctttctcat

SEQ ID NO: 3507 - DNA, 15 bp, Homo sapiens
tactgttctttctca

SEQ ID NO: 3508 - DNA, 15 bp, Homo sapiens
atactgttctttctc

SEQ ID NO: 3509 - DNA, 15 bp, Homo sapiens
aatactgttctttct

SEQ ID NO: 3510 - DNA, 15 bp, Homo sapiens
taatactgttctttc

SEQ ID NO: 3511 - DNA, 15 bp, Homo sapiens
gtaatactgttcttt

SEQ ID NO: 3512 - DNA, 15 bp, Homo sapiens
tgtaatactgttctt

SEQ ID NO: 3513 - DNA, 15 bp, Homo sapiens
atgtaatactgttct

SEQ ID NO: 3514 - DNA, 15 bp, Homo sapiens
tatgtaatactgttc

SEQ ID NO: 3515 - DNA, 15 bp, Homo sapiens
gtatgtaatactgtt

SEQ ID NO: 3516 - DNA, 15 bp, Homo sapiens
agtatgtaatactgt

SEQ ID NO: 3517 - DNA, 15 bp, Homo sapiens
cagtatgtaatactg

SEQ ID NO: 3518 - DNA, 15 bp, Homo sapiens
acagtatgtaatact

SEQ ID NO: 3519 - DNA, 15 bp, Homo sapiens
aacagtatgtaatac

SEQ ID NO: 3520 - DNA, 15 bp, Homo sapiens
aaacagtatgtaata

SEQ ID NO: 3521 - DNA, 15 bp, Homo sapiens
aaaacagtatgtaat

SEQ ID NO: 3522 - DNA, 15 bp, Homo sapiens
caaaacagtatgtaa

SEQ ID NO: 3523 - DNA, 15 bp, Homo sapiens
ccaaaacagtatgta

SEQ ID NO: 3524 - DNA, 15 bp, Homo sapiens
tccaaaacagtatgt

SEQ ID NO: 3525 - DNA, 15 bp, Homo sapiens
ttccaaaacagtatg

SEQ ID NO: 3526 - DNA, 15 bp, Homo sapiens
cttccaaaacagtat

SEQ ID NO: 3527 - DNA, 15 bp, Homo sapiens
tcttccaaaacagta

SEQ ID NO: 3528 - DNA, 15 bp, Homo sapiens
ttcttccaaaacagt

SEQ ID NO: 3529 - DNA, 15 bp, Homo sapiens
tttcttccaaaacag

SEQ ID NO: 3530 - DNA, 15 bp, Homo sapiens
ctttcttccaaaaca

SEQ ID NO: 3531 - DNA, 15 bp, Homo sapiens
gctttcttccaaaac

SEQ ID NO: 3532 - DNA, 15 bp, Homo sapiens
agctttcttccaaaa

SEQ ID NO: 3533 - DNA, 15 bp, Homo sapiens
gagctttcttccaaa

SEQ ID NO: 3534 - DNA, 15 bp, Homo sapiens
tgagctttcttccaa

SEQ ID NO: 3535 - DNA, 15 bp, Homo sapiens
atgagctttcttcca

SEQ ID NO: 3536 - DNA, 15 bp, Homo sapiens
aatgagctttcttcc

SEQ ID NO: 3537 - DNA, 15 bp, Homo sapiens
gaatgagctttcttc

SEQ ID NO: 3538 - DNA, 15 bp, Homo sapiens
tgaatgagctttctt

SEQ ID NO: 3539 - DNA, 15 bp, Homo sapiens
gtgaatgagctttct

SEQ ID NO: 3540 - DNA, 15 bp, Homo sapiens
tgtgaatgagctttc

SEQ ID NO: 3541 - DNA, 15 bp, Homo sapiens
gtgtgaatgagcttt

SEQ ID NO: 3542 - DNA, 15 bp, Homo sapiens
agtgtgaatgagctt

SEQ ID NO: 3543 - DNA, 15 bp, Homo sapiens
tagtgtgaatgagct

SEQ ID NO: 3544 - DNA, 15 bp, Homo sapiens
ctagtgtgaatgagc

SEQ ID NO: 3545 - DNA, 15 bp, Homo sapiens
tctagtgtgaatgag

SEQ ID NO: 3546 - DNA, 15 bp, Homo sapiens
ctctagtgtgaatga

SEQ ID NO: 3547 - DNA, 15 bp, Homo sapiens
gctctagtgtgaatg

SEQ ID NO: 3548 - DNA, 15 bp, Homo sapiens
agctctagtgtgaat

SEQ ID NO: 3549 - DNA, 15 bp, Homo sapiens
aagctctagtgtgaa

SEQ ID NO: 3550 - DNA, 15 bp, Homo sapiens
caagctctagtgtga

SEQ ID NO: 3551 - DNA, 15 bp, Homo sapiens
acaagctctagtgtg

SEQ ID NO: 3552 - DNA, 15 bp, Homo sapiens
cacaagctctagtgt

SEQ ID NO: 3553 - DNA, 15 bp, Homo sapiens
ccacaagctctagtg

SEQ ID NO: 3554 - DNA, 15 bp, Homo sapiens
cccacaagctctagt

SEQ ID NO: 3555 - DNA, 15 bp, Homo sapiens
tcccacaagctctag

SEQ ID NO: 3556 - DNA, 15 bp, Homo sapiens
ctcccacaagctcta

SEQ ID NO: 3557 - DNA, 15 bp, Homo sapiens
gctcccacaagctct

SEQ ID NO: 3558 - DNA, 15 bp, Homo sapiens
agctcccacaagctc

SEQ ID NO: 3559 - DNA, 15 bp, Homo sapiens
tagctcccacaagct

SEQ ID NO: 3560 - DNA, 15 bp, Homo sapiens
ctagctcccacaagc

SEQ ID NO: 3561 - DNA, 15 bp, Homo sapiens
gctagctcccacaag

SEQ ID NO: 3562 - DNA, 15 bp, Homo sapiens
tgctagctcccacaa

SEQ ID NO: 3563 - DNA, 15 bp, Homo sapiens
ttgctagctcccaca

SEQ ID NO: 3564 - DNA, 15 bp, Homo sapiens
cttgctagctcccac

SEQ ID NO: 3565 - DNA, 15 bp, Homo sapiens
gcttgctagctccca

SEQ ID NO: 3566 - DNA, 15 bp, Homo sapiens
agcttgctagctccc

SEQ ID NO: 3567 - DNA, 15 bp, Homo sapiens
gagcttgctagctcc

SEQ ID NO: 3568 - DNA, 15 bp, Homo sapiens
agagcttgctagctc

SEQ ID NO: 3569 - DNA, 15 bp, Homo sapiens
cagagcttgctagct

SEQ ID NO: 3570 - DNA, 15 bp, Homo sapiens
tcagagcttgctagc

SEQ ID NO: 3571 - DNA, 15 bp, Homo sapiens
atcagagcttgctag

SEQ ID NO: 3572 - DNA, 15 bp, Homo sapiens
aatcagagcttgcta

SEQ ID NO: 3573 - DNA, 15 bp, Homo sapiens
caatcagagcttgct

SEQ ID NO: 3574 - DNA, 15 bp, Homo sapiens
ccaatcagagcttgc

SEQ ID NO: 3575 - DNA, 15 bp, Homo sapiens
accaatcagagcttg

SEQ ID NO: 3576 - DNA, 15 bp, Homo sapiens
caccaatcagagctt

SEQ ID NO: 3577 - DNA, 15 bp, Homo sapiens
tcaccaatcagagct

SEQ ID NO: 3578 - DNA, 15 bp, Homo sapiens
ctcaccaatcagagc

SEQ ID NO: 3579 - DNA, 15 bp, Homo sapiens
gctcaccaatcagag

SEQ ID NO: 3580 - DNA, 15 bp, Homo sapiens
cgctcaccaatcaga

SEQ ID NO: 3581 - DNA, 15 bp, Homo sapiens
tcgctcaccaatcag

SEQ ID NO: 3582 - DNA, 15 bp, Homo sapiens
atcgctcaccaatca

SEQ ID NO: 3583 - DNA, 15 bp, Homo sapiens
catcgctcaccaatc

SEQ ID NO: 3584 - DNA, 15 bp, Homo sapiens
ccatcgctcaccaat

SEQ ID NO: 3585 - DNA, 15 bp, Homo sapiens
accatcgctcaccaa

SEQ ID NO: 3586 - DNA, 15 bp, Homo sapiens
caccatcgctcacca

SEQ ID NO: 3587 - DNA, 15 bp, Homo sapiens
ccaccatcgctcacc

SEQ ID NO: 3588 - DNA, 15 bp, Homo sapiens
accaccatcgctcac

SEQ ID NO: 3589 - DNA, 15 bp, Homo sapiens
taccaccatcgctca

SEQ ID NO: 3590 - DNA, 15 bp, Homo sapiens
ctaccaccatcgctc

SEQ ID NO: 3591 - DNA, 15 bp, Homo sapiens
cctaccaccatcgct

SEQ ID NO: 3592 - DNA, 15 bp, Homo sapiens
acctaccaccatcgc

SEQ ID NO: 3593 - DNA, 15 bp, Homo sapiens
tacctaccaccatcg

SEQ ID NO: 3594 - DNA, 15 bp, Homo sapiens
ttacctaccaccatc

SEQ ID NO: 3595 - DNA, 15 bp, Homo sapiens
tttacctaccaccat

SEQ ID NO: 3596 - DNA, 15 bp, Homo sapiens
ttttacctaccacca

SEQ ID NO: 3597 - DNA, 15 bp, Homo sapiens
gttttacctaccacc

SEQ ID NO: 3598 - DNA, 15 bp, Homo sapiens
ggttttacctaccac

SEQ ID NO: 3599 - DNA, 15 bp, Homo sapiens
tggttttacctacca

SEQ ID NO: 3600 - DNA, 15 bp, Homo sapiens
ctggttttacctacc

SEQ ID NO: 3601 - DNA, 15 bp, Homo sapiens
actggttttacctac

SEQ ID NO: 3602 - DNA, 15 bp, Homo sapiens
gactggttttaccta

SEQ ID NO: 3603 - DNA, 15 bp, Homo sapiens
agactggttttacct

SEQ ID NO: 3604 - DNA, 15 bp, Homo sapiens
aagactggttttacc

SEQ ID NO: 3605 - DNA, 15 bp, Homo sapiens
taagactggttttac

SEQ ID NO: 3606 - DNA, 15 bp, Homo sapiens
ctaagactggtttta

SEQ ID NO: 3607 - DNA, 15 bp, Homo sapiens
tctaagactggtttt

SEQ ID NO: 3608 - DNA, 15 bp, Homo sapiens
ctctaagactggttt

SEQ ID NO: 3609 - DNA, 15 bp, Homo sapiens
actctaagactggtt

SEQ ID NO: 3610 - DNA, 15 bp, Homo sapiens
gactctaagactggt

SEQ ID NO: 3611 - DNA, 15 bp, Homo sapiens
tgactctaagactgg

SEQ ID NO: 3612 - DNA, 15 bp, Homo sapiens
atgactctaagactg

SEQ ID NO: 3613 - DNA, 15 bp, Homo sapiens
catgactctaagact

SEQ ID NO: 3614 - DNA, 15 bp, Homo sapiens
ccatgactctaagac

SEQ ID NO: 3615 - DNA, 15 bp, Homo sapiens
gccatgactctaaga

SEQ ID NO: 3616 - DNA, 15 bp, Homo sapiens
tgccatgactctaag

SEQ ID NO: 3617 - DNA, 15 bp, Homo sapiens
ctgccatgactctaa

SEQ ID NO: 3618 - DNA, 15 bp, Homo sapiens
actgccatgactcta

SEQ ID NO: 3619 - DNA, 15 bp, Homo sapiens
aactgccatgactct

SEQ ID NO: 3620 - DNA, 15 bp, Homo sapiens
gaactgccatgactc

SEQ ID NO: 3621 - DNA, 15 bp, Homo sapiens
tgaactgccatgact

SEQ ID NO: 3622 - DNA, 15 bp, Homo sapiens
atgaactgccatgac

SEQ ID NO: 3623 - DNA, 15 bp, Homo sapiens
aatgaactgccatga

SEQ ID NO: 3624 - DNA, 15 bp, Homo sapiens
aaatgaactgccatg

SEQ ID NO: 3625 - DNA, 15 bp, Homo sapiens
aaaatgaactgccat

SEQ ID NO: 3626 - DNA, 15 bp, Homo sapiens
taaaatgaactgcca

SEQ ID NO: 3627 - DNA, 15 bp, Homo sapiens
ctaaaatgaactgcc

SEQ ID NO: 3628 - DNA, 15 bp, Homo sapiens
gctaaaatgaactgc

SEQ ID NO: 3629 - DNA, 15 bp, Homo sapiens
tgctaaaatgaactg

SEQ ID NO: 3630 - DNA, 15 bp, Homo sapiens
ctgctaaaatgaact

SEQ ID NO: 3631 - DNA, 15 bp, Homo sapiens
gctgctaaaatgaac

SEQ ID NO: 3632 - DNA, 15 bp, Homo sapiens
agctgctaaaatgaa

SEQ ID NO: 3633 - DNA, 15 bp, Homo sapiens
tagctgctaaaatga

SEQ ID NO: 3634 - DNA, 15 bp, Homo sapiens
atagctgctaaaatg

SEQ ID NO: 3635 - DNA, 15 bp, Homo sapiens
aatagctgctaaaat

SEQ ID NO: 3636 - DNA, 15 bp, Homo sapiens
taatagctgctaaaa

SEQ ID NO: 3637 - DNA, 15 bp, Homo sapiens
ctaatagctgctaaa

SEQ ID NO: 3638 - DNA, 15 bp, Homo sapiens
cctaatagctgctaa

SEQ ID NO: 3639 - DNA, 15 bp, Homo sapiens
acctaatagctgcta

SEQ ID NO: 3640 - DNA, 15 bp, Homo sapiens
tacctaatagctgct

SEQ ID NO: 3641 - DNA, 15 bp, Homo sapiens
ttacctaatagctgc

SEQ ID NO: 3642 - DNA, 15 bp, Homo sapiens
tttacctaatagctg

SEQ ID NO: 3643 - DNA, 15 bp, Homo sapiens
ttttacctaatagct

SEQ ID NO: 3644 - DNA, 15 bp, Homo sapiens
gttttacctaatagc

SEQ ID NO: 3645 - DNA, 15 bp, Homo sapiens
agttttacctaatag

SEQ ID NO: 3646 - DNA, 15 bp, Homo sapiens
cagttttacctaata

SEQ ID NO: 3647 - DNA, 15 bp, Homo sapiens
ccagttttacctaat

SEQ ID NO: 3648 - DNA, 15 bp, Homo sapiens
accagttttacctaa

SEQ ID NO: 3649 - DNA, 15 bp, Homo sapiens
gaccagttttaccta

SEQ ID NO: 3650 - DNA, 15 bp, Homo sapiens
agaccagttttacct

SEQ ID NO: 3651 - DNA, 15 bp, Homo sapiens
aagaccagttttacc

SEQ ID NO: 3652 - DNA, 15 bp, Homo sapiens
taagaccagttttac

SEQ ID NO: 3653 - DNA, 15 bp, Homo sapiens
ctaagaccagtttta

SEQ ID NO: 3654 - DNA, 15 bp, Homo sapiens
cctaagaccagtttt

SEQ ID NO: 3655 - DNA, 15 bp, Homo sapiens
ccctaagaccagttt

SEQ ID NO: 3656 - DNA, 15 bp, Homo sapiens
tccctaagaccagtt

SEQ ID NO: 3657 - DNA, 15 bp, Homo sapiens
atccctaagaccagt

SEQ ID NO: 3658 - DNA, 15 bp, Homo sapiens
tatccctaagaccag

SEQ ID NO: 3659 - DNA, 15 bp, Homo sapiens
gtatccctaagacca

SEQ ID NO: 3660 - DNA, 15 bp, Homo sapiens
tgtatccctaagacc

SEQ ID NO: 3661 - DNA, 15 bp, Homo sapiens
ctgtatccctaagac

SEQ ID NO: 3662 - DNA, 15 bp, Homo sapiens
tctgtatccctaaga

SEQ ID NO: 3663 - DNA, 15 bp, Homo sapiens
ttctgtatccctaag

SEQ ID NO: 3664 - DNA, 15 bp, Homo sapiens
cttctgtatccctaa

SEQ ID NO: 3665 - DNA, 15 bp, Homo sapiens
ccttctgtatcccta

SEQ ID NO: 3666 - DNA, 15 bp, Homo sapiens
gccttctgtatccct

SEQ ID NO: 3667 - DNA, 15 bp, Homo sapiens
agccttctgtatccc

SEQ ID NO: 3668 - DNA, 15 bp, Homo sapiens
cagccttctgtatcc

SEQ ID NO: 3669 - DNA, 15 bp, Homo sapiens
ccagccttctgtatc

SEQ ID NO: 3670 - DNA, 15 bp, Homo sapiens
accagccttctgtat

SEQ ID NO: 3671 - DNA, 15 bp, Homo sapiens
aaccagccttctgta

SEQ ID NO: 3672 - DNA, 15 bp, Homo sapiens
gaaccagccttctgt

SEQ ID NO: 3673 - DNA, 15 bp, Homo sapiens
tgaaccagccttctg

SEQ ID NO: 3674 - DNA, 15 bp, Homo sapiens
ctgaaccagccttct

SEQ ID NO: 3675 - DNA, 15 bp, Homo sapiens
gctgaaccagccttc

SEQ ID NO: 3676 - DNA, 15 bp, Homo sapiens
tgctgaaccagcctt

SEQ ID NO: 3677 - DNA, 15 bp, Homo sapiens
ctgctgaaccagcct

SEQ ID NO: 3678 - DNA, 15 bp, Homo sapiens
actgctgaaccagcc

SEQ ID NO: 3679 - DNA, 15 bp, Homo sapiens
aactgctgaaccagc

SEQ ID NO: 3680 - DNA, 15 bp, Homo sapiens
caactgctgaaccag

SEQ ID NO: 3681 - DNA, 15 bp, Homo sapiens
ccaactgctgaacca

SEQ ID NO: 3682 - DNA, 15 bp, Homo sapiens
tccaactgctgaacc

SEQ ID NO: 3683 - DNA, 15 bp, Homo sapiens
gtccaactgctgaac

SEQ ID NO: 3684 - DNA, 15 bp, Homo sapiens
agtccaactgctgaa

SEQ ID NO: 3685 - DNA, 15 bp, Homo sapiens
aagtccaactgctga

SEQ ID NO: 3686 - DNA, 15 bp, Homo sapiens
caagtccaactgctg

SEQ ID NO: 3687 - DNA, 15 bp, Homo sapiens
acaagtccaactgct

SEQ ID NO: 3688 - DNA, 15 bp, Homo sapiens
cacaagtccaactgc

SEQ ID NO: 3689 - DNA, 15 bp, Homo sapiens
ccacaagtccaactg

SEQ ID NO: 3690 - DNA, 15 bp, Homo sapiens
tccacaagtccaact

SEQ ID NO: 3691 - DNA, 15 bp, Homo sapiens
ttccacaagtccaac

SEQ ID NO: 3692 - DNA, 15 bp, Homo sapiens
tttccacaagtccaa

SEQ ID NO: 3693 - DNA, 15 bp, Homo sapiens
ttttccacaagtcca

SEQ ID NO: 3694 - DNA, 15 bp, Homo sapiens
attttccacaagtcc

SEQ ID NO: 3695 - DNA, 15 bp, Homo sapiens
aattttccacaagtc

SEQ ID NO: 3696 - DNA, 15 bp, Homo sapiens
aaattttccacaagt

SEQ ID NO: 3697 - DNA, 15 bp, Homo sapiens
taaattttccacaag

SEQ ID NO: 3698 - DNA, 15 bp, Homo sapiens
ttaaattttccacaa

SEQ ID NO: 3699 - DNA, 15 bp, Homo sapiens
attaaattttccaca

SEQ ID NO: 3700 - DNA, 15 bp, Homo sapiens
aattaaattttccac

SEQ ID NO: 3701 - DNA, 15 bp, Homo sapiens
gaattaaattttcca

SEQ ID NO: 3702 - DNA, 15 bp, Homo sapiens
agaattaaattttcc

SEQ ID NO: 3703 - DNA, 15 bp, Homo sapiens
aagaattaaattttc

SEQ ID NO: 3704 - DNA, 15 bp, Homo sapiens
caagaattaaatttt

SEQ ID NO: 3705 - DNA, 15 bp, Homo sapiens
tcaagaattaaattt

SEQ ID NO: 3706 - DNA, 15 bp, Homo sapiens
ttcaagaattaaatt

SEQ ID NO: 3707 - DNA, 15 bp, Homo sapiens
cttcaagaattaaat

SEQ ID NO: 3708 - DNA, 15 bp, Homo sapiens
gcttcaagaattaaa

SEQ ID NO: 3709 - DNA, 15 bp, Homo sapiens
tgcttcaagaattaa

SEQ ID NO: 3710 - DNA, 15 bp, Homo sapiens
ctgcttcaagaatta

SEQ ID NO: 3711 - DNA, 15 bp, Homo sapiens
tctgcttcaagaatt

SEQ ID NO: 3712 - DNA, 15 bp, Homo sapiens
atctgcttcaagaat

SEQ ID NO: 3713 - DNA, 15 bp, Homo sapiens
catctgcttcaagaa

SEQ ID NO: 3714 - DNA, 15 bp, Homo sapiens
gcatctgcttcaaga

SEQ ID NO: 3715 - DNA, 15 bp, Homo sapiens
agcatctgcttcaag

SEQ ID NO: 3716 - DNA, 15 bp, Homo sapiens
cagcatctgcttcaa

SEQ ID NO: 3717 - DNA, 15 bp, Homo sapiens
acagcatctgcttca

SEQ ID NO: 3718 - DNA, 15 bp, Homo sapiens
cacagcatctgcttc

SEQ ID NO: 3719 - DNA, 15 bp, Homo sapiens
acacagcatctgctt

SEQ ID NO: 3720 - DNA, 15 bp, Homo sapiens
cacacagcatctgct

SEQ ID NO: 3721 - DNA, 15 bp, Homo sapiens
gcacacagcatctgc

SEQ ID NO: 3722 - DNA, 15 bp, Homo sapiens
ggcacacagcatctg

SEQ ID NO: 3723 - DNA, 15 bp, Homo sapiens
gggcacacagcatct

SEQ ID NO: 3724 - DNA, 15 bp, Homo sapiens
ggggcacacagcatc

SEQ ID NO: 3725 - DNA, 15 bp, Homo sapiens
cggggcacacagcat

SEQ ID NO: 3726 - DNA, 15 bp, Homo sapiens
tcggggcacacagca

SEQ ID NO: 3727 - DNA, 15 bp, Homo sapiens
ttcggggcacacagc

SEQ ID NO: 3728 - DNA, 15 bp, Homo sapiens
attcggggcacacag

SEQ ID NO: 3729 - DNA, 15 bp, Homo sapiens
cattcggggcacaca

SEQ ID NO: 3730 - DNA, 15 bp, Homo sapiens
gcattcggggcacac

SEQ ID NO: 3731 - DNA, 15 bp, Homo sapiens
agcattcggggcaca

SEQ ID NO: 3732 - DNA, 15 bp, Homo sapiens
aagcattcggggcac

SEQ ID NO: 3733 - DNA, 15 bp, Homo sapiens
gaagcattcggggca

SEQ ID NO: 3734 - DNA, 15 bp, Homo sapiens
agaagcattcggggc

SEQ ID NO: 3735 - DNA, 15 bp, Homo sapiens
aagaagcattcgggg

SEQ ID NO: 3736 - DNA, 15 bp, Homo sapiens
gaagaagcattcggg

SEQ ID NO: 3737 - DNA, 15 bp, Homo sapiens
ggaagaagcattcgg

SEQ ID NO: 3738 - DNA, 15 bp, Homo sapiens
gggaagaagcattcg

SEQ ID NO: 3739 - DNA, 15 bp, Homo sapiens
ggggaagaagcattc

SEQ ID NO: 3740 - DNA, 15 bp, Homo sapiens
gggggaagaagcatt

SEQ ID NO: 3741 - DNA, 15 bp, Homo sapiens
agggggaagaagcat

SEQ ID NO: 3742 - DNA, 15 bp, Homo sapiens
cagggggaagaagca

SEQ ID NO: 3743 - DNA, 15 bp, Homo sapiens
ccagggggaagaagc

SEQ ID NO: 3744 - DNA, 15 bp, Homo sapiens
gccagggggaagaag

SEQ ID NO: 3745 - DNA, 15 bp, Homo sapiens
ggccagggggaagaa

SEQ ID NO: 3746 - DNA, 15 bp, Homo sapiens
gggccagggggaaga

SEQ ID NO: 3747 - DNA, 15 bp, Homo sapiens
agggccagggggaag

SEQ ID NO: 3748 - DNA, 15 bp, Homo sapiens
aagggccagggggaa

SEQ ID NO: 3749 - DNA, 15 bp, Homo sapiens
gaagggccaggggga

SEQ ID NO: 3750 - DNA, 15 bp, Homo sapiens
tgaagggccaggggg

SEQ ID NO: 3751 - DNA, 15 bp, Homo sapiens
ttgaagggccagggg

SEQ ID NO: 3752 - DNA, 15 bp, Homo sapiens
gttgaagggccaggg

SEQ ID NO: 3753 - DNA, 15 bp, Homo sapiens
agttgaagggccagg

SEQ ID NO: 3754 - DNA, 15 bp, Homo sapiens
gagttgaagggccag

SEQ ID NO: 3755 - DNA, 15 bp, Homo sapiens
agagttgaagggcca

SEQ ID NO: 3756 - DNA, 15 bp, Homo sapiens
cagagttgaagggcc

SEQ ID NO: 3757 - DNA, 15 bp, Homo sapiens
tcagagttgaagggc

SEQ ID NO: 3758 - DNA, 15 bp, Homo sapiens
atcagagttgaaggg

SEQ ID NO: 3759 - DNA, 15 bp, Homo sapiens
aatcagagttgaagg

SEQ ID NO: 3760 - DNA, 15 bp, Homo sapiens
aaatcagagttgaag

SEQ ID NO: 3761 - DNA, 15 bp, Homo sapiens
taaatcagagttgaa

SEQ ID NO: 3762 - DNA, 15 bp, Homo sapiens
ctaaatcagagttga

SEQ ID NO: 3763 - DNA, 15 bp, Homo sapiens
actaaatcagagttg

SEQ ID NO: 3764 - DNA, 15 bp, Homo sapiens
aactaaatcagagtt

SEQ ID NO: 3765 - DNA, 15 bp, Homo sapiens
caactaaatcagagt

SEQ ID NO: 3766 - DNA, 15 bp, Homo sapiens
tcaactaaatcagag

SEQ ID NO: 3767 - DNA, 15 bp, Homo sapiens
ctcaactaaatcaga

SEQ ID NO: 3768 - DNA, 15 bp, Homo sapiens
actcaactaaatcag

SEQ ID NO: 3769 - DNA, 15 bp, Homo sapiens
tactcaactaaatca

SEQ ID NO: 3770 - DNA, 15 bp, Homo sapiens
atactcaactaaatc

SEQ ID NO: 3771 - DNA, 15 bp, Homo sapiens
aatactcaactaaat

SEQ ID NO: 3772 - DNA, 15 bp, Homo sapiens
aaatactcaactaaa

SEQ ID NO: 3773 - DNA, 15 bp, Homo sapiens
gaaatactcaactaa

SEQ ID NO: 3774 - DNA, 15 bp, Homo sapiens
tgaaatactcaacta

SEQ ID NO: 3775 - DNA, 15 bp, Homo sapiens
ttgaaatactcaact

SEQ ID NO: 3776 - DNA, 15 bp, Homo sapiens
cttgaaatactcaac

SEQ ID NO: 3777 - DNA, 15 bp, Homo sapiens
tcttgaaatactcaa

SEQ ID NO: 3778 - DNA, 15 bp, Homo sapiens
ttcttgaaatactca

SEQ ID NO: 3779 - DNA, 15 bp, Homo sapiens
attcttgaaatactc

SEQ ID NO: 3780 - DNA, 15 bp, Homo sapiens
cattcttgaaatact

SEQ ID NO: 3781 - DNA, 15 bp, Homo sapiens
tcattcttgaaatac

SEQ ID NO: 3782 - DNA, 15 bp, Homo sapiens
gtcattcttgaaata

SEQ ID NO: 3783 - DNA, 15 bp, Homo sapiens
ggtcattcttgaaat

SEQ ID NO: 3784 - DNA, 15 bp, Homo sapiens
gggtcattcttgaaa

SEQ ID NO: 3785 - DNA, 15 bp, Homo sapiens
tgggtcattcttgaa

SEQ ID NO: 3786 - DNA, 15 bp, Homo sapiens
ttgggtcattcttga

SEQ ID NO: 3787 - DNA, 15 bp, Homo sapiens
attgggtcattcttg

SEQ ID NO: 3788 - DNA, 15 bp, Homo sapiens
aattgggtcattctt

SEQ ID NO: 3789 - DNA, 15 bp, Homo sapiens
aaattgggtcattct

SEQ ID NO: 3790 - DNA, 15 bp, Homo sapiens
taaattgggtcattc

SEQ ID NO: 3791 - DNA, 15 bp, Homo sapiens
ataaattgggtcatt

SEQ ID NO: 3792 - DNA, 15 bp, Homo sapiens
cataaattgggtcat

SEQ ID NO: 3793 - DNA, 15 bp, Homo sapiens
acataaattgggtca

SEQ ID NO: 3794 - DNA, 15 bp, Homo sapiens
tacataaattgggtc

SEQ ID NO: 3795 - DNA, 15 bp, Homo sapiens
ttacataaattgggt

SEQ ID NO: 3796 - DNA, 15 bp, Homo sapiens
attacataaattggg

SEQ ID NO: 3797 - DNA, 15 bp, Homo sapiens
gattacataaattgg

SEQ ID NO: 3798 - DNA, 15 bp, Homo sapiens
tgattacataaattg

SEQ ID NO: 3799 - DNA, 15 bp, Homo sapiens
ttgattacataaatt

SEQ ID NO: 3800 - DNA, 15 bp, Homo sapiens
gttgattacataaat

SEQ ID NO: 3801 - DNA, 15 bp, Homo sapiens
agttgattacataaa

SEQ ID NO: 3802 - DNA, 15 bp, Homo sapiens
aagttgattacataa

SEQ ID NO: 3803 - DNA, 15 bp, Homo sapiens
aaagttgattacata

SEQ ID NO: 3804 - DNA, 15 bp, Homo sapiens
gaaagttgattacat

SEQ ID NO: 3805 - DNA, 15 bp, Homo sapiens
tgaaagttgattaca

SEQ ID NO: 3806 - DNA, 15 bp, Homo sapiens
gtgaaagttgattac

SEQ ID NO: 3807 - DNA, 15 bp, Homo sapiens
tgtgaaagttgatta

SEQ ID NO: 3808 - DNA, 15 bp, Homo sapiens
ctgtgaaagttgatt

SEQ ID NO: 3809 - DNA, 15 bp, Homo sapiens
cctgtgaaagttgat

SEQ ID NO: 3810 - DNA, 15 bp, Homo sapiens
acctgtgaaagttga

SEQ ID NO: 3811 - DNA, 15 bp, Homo sapiens
tacctgtgaaagttg

SEQ ID NO: 3812 - DNA, 15 bp, Homo sapiens
atacctgtgaaagtt

SEQ ID NO: 3813 - DNA, 15 bp, Homo sapiens
tatacctgtgaaagt

SEQ ID NO: 3814 - DNA, 15 bp, Homo sapiens
gtatacctgtgaaag

SEQ ID NO: 3815 - DNA, 15 bp, Homo sapiens
tgtatacctgtgaaa

SEQ ID NO: 3816 - DNA, 15 bp, Homo sapiens
atgtatacctgtgaa

SEQ ID NO: 3817 - DNA, 15 bp, Homo sapiens
catgtatacctgtga

SEQ ID NO: 3818 - DNA, 15 bp, Homo sapiens
acatgtatacctgtg

SEQ ID NO: 3819 - DNA, 15 bp, Homo sapiens
gacatgtatacctgt

SEQ ID NO: 3820 - DNA, 15 bp, Homo sapiens
agacatgtatacctg

SEQ ID NO: 3821 - DNA, 15 bp, Homo sapiens
aagacatgtatacct

SEQ ID NO: 3822 - DNA, 15 bp, Homo sapiens
taagacatgtatacc

SEQ ID NO: 3823 - DNA, 15 bp, Homo sapiens
ttaagacatgtatac

SEQ ID NO: 3824 - DNA, 15 bp, Homo sapiens
tttaagacatgtata

SEQ ID NO: 3825 - DNA, 15 bp, Homo sapiens
gtttaagacatgtat

SEQ ID NO: 3826 - DNA, 15 bp, Homo sapiens
agtttaagacatgta

SEQ ID NO: 3827 - DNA, 15 bp, Homo sapiens
aagtttaagacatgt

SEQ ID NO: 3828 - DNA, 15 bp, Homo sapiens
aaagtttaagacatg

SEQ ID NO: 3829 - DNA, 15 bp, Homo sapiens
taaagtttaagacat

SEQ ID NO: 3830 - DNA, 15 bp, Homo sapiens
ttaaagtttaagaca

SEQ ID NO: 3831 - DNA, 15 bp, Homo sapiens
tttaaagtttaagac

SEQ ID NO: 3832 - DNA, 15 bp, Homo sapiens
gtttaaagtttaaga

SEQ ID NO: 3833 - DNA, 15 bp, Homo sapiens
tgtttaaagtttaag

SEQ ID NO: 3834 - DNA, 15 bp, Homo sapiens
ctgtttaaagtttaa

SEQ ID NO: 3835 - DNA, 15 bp, Homo sapiens
tctgtttaaagttta

SEQ ID NO: 3836 - DNA, 15 bp, Homo sapiens
atctgtttaaagttt

SEQ ID NO: 3837 - DNA, 15 bp, Homo sapiens
catctgtttaaagtt

SEQ ID NO: 3838 - DNA, 15 bp, Homo sapiens
acatctgtttaaagt

SEQ ID NO: 3839 - DNA, 15 bp, Homo sapiens
aacatctgtttaaag

SEQ ID NO: 3840 - DNA, 15 bp, Homo sapiens
aaacatctgtttaaa

SEQ ID NO: 3841 - DNA, 15 bp, Homo sapiens
aaaacatctgtttaa

SEQ ID NO: 3842 - DNA, 15 bp, Homo sapiens
caaaacatctgttta

SEQ ID NO: 3843 - DNA, 15 bp, Homo sapiens
ccaaaacatctgttt

SEQ ID NO: 3844 - DNA, 15 bp, Homo sapiens
cccaaaacatctgtt

SEQ ID NO: 3845 - DNA, 15 bp, Homo sapiens
acccaaaacatctgt

SEQ ID NO: 3846 - DNA, 15 bp, Homo sapiens
aacccaaaacatctg

SEQ ID NO: 3847 - DNA, 15 bp, Homo sapiens
aaacccaaaacatct

SEQ ID NO: 3848 - DNA, 15 bp, Homo sapiens
aaaacccaaaacatc

SEQ ID NO: 3849 - DNA, 15 bp, Homo sapiens
caaaacccaaaacat

SEQ ID NO: 3850 - DNA, 15 bp, Homo sapiens
acaaaacccaaaaca

SEQ ID NO: 3851 - DNA, 15 bp, Homo sapiens
aacaaaacccaaaac

SEQ ID NO: 3852 - DNA, 15 bp, Homo sapiens
caacaaaacccaaaa

SEQ ID NO: 3853 - DNA, 15 bp, Homo sapiens
acaacaaaacccaaa

SEQ ID NO: 3854 - DNA, 15 bp, Homo sapiens
aacaacaaaacccaa

SEQ ID NO: 3855 - DNA, 15 bp, Homo sapiens
caacaacaaaaccca

SEQ ID NO: 3856 - DNA, 15 bp, Homo sapiens
acaacaacaaaaccc

SEQ ID NO: 3857 - DNA, 15 bp, Homo sapiens
aacaacaacaaaacc

SEQ ID NO: 3858 - DNA, 15 bp, Homo sapiens
caacaacaacaaaac

SEQ ID NO: 3859 - DNA, 15 bp, Homo sapiens
acaacaacaacaaaa

SEQ ID NO: 3860 - DNA, 15 bp, Homo sapiens
aacaacaacaacaaa

SEQ ID NO: 3861 - DNA, 15 bp, Homo sapiens
aaacaacaacaacaa

SEQ ID NO: 3862 - DNA, 15 bp, Homo sapiens
aaaacaacaacaaca

SEQ ID NO: 3863 - DNA, 15 bp, Homo sapiens
aaaaacaacaacaac

SEQ ID NO: 3864 - DNA, 15 bp, Homo sapiens
caaaaacaacaacaa

SEQ ID NO: 3865 - DNA, 15 bp, Homo sapiens
tcaaaaacaacaaca

SEQ ID NO: 3866 - DNA, 15 bp, Homo sapiens
ctcaaaaacaacaac

SEQ ID NO: 3867 - DNA, 15 bp, Homo sapiens
tctcaaaaacaacaa

SEQ ID NO: 3868 - DNA, 15 bp, Homo sapiens
gtctcaaaaacaaca

SEQ ID NO: 3869 - DNA, 15 bp, Homo sapiens
cgtctcaaaaacaac

SEQ ID NO: 3870 - DNA, 15 bp, Homo sapiens
ccgtctcaaaaacaa

SEQ ID NO: 3871 - DNA, 15 bp, Homo sapiens
tccgtctcaaaaaca

SEQ ID NO: 3872 - DNA, 15 bp, Homo sapiens
ctccgtctcaaaaac

SEQ ID NO: 3873 - DNA, 15 bp, Homo sapiens
gactccgtctcaaaa

SEQ ID NO: 3874 - DNA, 15 bp, Homo sapiens
agactccgtctcaaa

SEQ ID NO: 3875 - DNA, 15 bp, Homo sapiens
gagactccgtctcaa

SEQ ID NO: 3876 - DNA, 15 bp, Homo sapiens
tgagactccgtctca

SEQ ID NO: 3877 - DNA, 15 bp, Homo sapiens
gtgagactccgtctc

SEQ ID NO: 3878 - DNA, 15 bp, Homo sapiens
agtgagactccgtct

SEQ ID NO: 3879 - DNA, 15 bp, Homo sapiens
gagtgagactccgtc

SEQ ID NO: 3880 - DNA, 15 bp, Homo sapiens
agagtgagactccgt

SEQ ID NO: 3881 - DNA, 15 bp, Homo sapiens
cagagtgagactccg

SEQ ID NO: 3882 - DNA, 15 bp, Homo sapiens
aacagagtgagactc

SEQ ID NO: 3883 - DNA, 15 bp, Homo sapiens
caacagagtgagact

SEQ ID NO: 3884 - DNA, 15 bp, Homo sapiens
acaacagagtgagac

SEQ ID NO: 3885 - DNA, 15 bp, Homo sapiens
gacaacagagtgaga

SEQ ID NO: 3886 - DNA, 15 bp, Homo sapiens
ggacaacagagtgag

SEQ ID NO: 3887 - DNA, 15 bp, Homo sapiens
tggacaacagagtga

SEQ ID NO: 3888 - DNA, 15 bp, Homo sapiens
ttggacaacagagtg

SEQ ID NO: 3889 - DNA, 15 bp, Homo sapiens
cttggacaacagagt

SEQ ID NO: 3890 - DNA, 15 bp, Homo sapiens
gcttggacaacagag

SEQ ID NO: 3891 - DNA, 15 bp, Homo sapiens
agcttggacaacaga

SEQ ID NO: 3892 - DNA, 15 bp, Homo sapiens
cagcttggacaacag

SEQ ID NO: 3893 - DNA, 15 bp, Homo sapiens
ccagcttggacaaca

SEQ ID NO: 3894 - DNA, 15 bp, Homo sapiens
tccagcttggacaac

SEQ ID NO: 3895 - DNA, 15 bp, Homo sapiens
ctccagcttggacaa

SEQ ID NO: 3896 - DNA, 15 bp, Homo sapiens
actccagcttggaca

SEQ ID NO: 3897 - DNA, 15 bp, Homo sapiens
cactccagcttggac

SEQ ID NO: 3898 - DNA, 15 bp, Homo sapiens
acactccagcttgga

SEQ ID NO: 3899 - DNA, 15 bp, Homo sapiens
tacactccagcttgg

SEQ ID NO: 3900 - DNA, 15 bp, Homo sapiens
ctacactccagcttg

SEQ ID NO: 3901 - DNA, 15 bp, Homo sapiens
actacactccagctt

SEQ ID NO: 3902 - DNA, 15 bp, Homo sapiens
cactacactccagct

SEQ ID NO: 3903 - DNA, 15 bp, Homo sapiens
ccactacactccagc

SEQ ID NO: 3904 - DNA, 15 bp, Homo sapiens
accactacactccag

SEQ ID NO: 3905 - DNA, 15 bp, Homo sapiens
caccactacactcca

SEQ ID NO: 3906 - DNA, 15 bp, Homo sapiens
acaccactacactcc

SEQ ID NO: 3907 - DNA, 15 bp, Homo sapiens
cacaccactacactc

SEQ ID NO: 3908 - DNA, 15 bp, Homo sapiens
tcacaccactacact

SEQ ID NO: 3909 - DNA, 15 bp, Homo sapiens
atcacaccactacac

SEQ ID NO: 3910 - DNA, 15 bp, Homo sapiens
gatcacaccactaca

SEQ ID NO: 3911 - DNA, 15 bp, Homo sapiens
agatcacaccactac

SEQ ID NO: 3912 - DNA, 15 bp, Homo sapiens
gagatcacaccacta

SEQ ID NO: 3913 - DNA, 15 bp, Homo sapiens
cgagatcacaccact

SEQ ID NO: 3914 - DNA, 15 bp, Homo sapiens
ccgagatcacaccac

SEQ ID NO: 3915 - DNA, 15 bp, Homo sapiens
gccgagatcacacca

SEQ ID NO: 3916 - DNA, 15 bp, Homo sapiens
agccgagatcacacc

SEQ ID NO: 3917 - DNA, 15 bp, Homo sapiens
gagccgagatcacac

SEQ ID NO: 3918 - DNA, 15 bp, Homo sapiens
tgagccgagatcaca

SEQ ID NO: 3919 - DNA, 15 bp, Homo sapiens
gtgagccgagatcac

SEQ ID NO: 3920 - DNA, 15 bp, Homo sapiens
agtgagccgagatca

SEQ ID NO: 3921 - DNA, 15 bp, Homo sapiens
cagtgagccgagatc

SEQ ID NO: 3922 - DNA, 15 bp, Homo sapiens
gttgcagtgagccga

SEQ ID NO: 3923 - DNA, 15 bp, Homo sapiens
ggttgcagtgagccg

SEQ ID NO: 3924 - DNA, 15 bp, Homo sapiens
aggttgcagtgagcc

SEQ ID NO: 3925 - DNA, 15 bp, Homo sapiens
tggaggcggaggttg

SEQ ID NO: 3926 - DNA, 15 bp, Homo sapiens
ctggaggcggaggtt

SEQ ID NO: 3927 - DNA, 15 bp, Homo sapiens
cctggaggcggaggt

SEQ ID NO: 3928 - DNA, 15 bp, Homo sapiens
ccctggaggcggagg

SEQ ID NO: 3929 - DNA, 15 bp, Homo sapiens
accctggaggcggag

SEQ ID NO: 3930 - DNA, 15 bp, Homo sapiens
gaccctggaggcgga

SEQ ID NO: 3931 - DNA, 15 bp, Homo sapiens
tgaccctggaggcgg

SEQ ID NO: 3932 - DNA, 15 bp, Homo sapiens
ttgaccctggaggcg

SEQ ID NO: 3933 - DNA, 15 bp, Homo sapiens
cttgaccctggaggc

SEQ ID NO: 3934 - DNA, 15 bp, Homo sapiens
acttgaccctggagg

SEQ ID NO: 3935 - DNA, 15 bp, Homo sapiens
cacttgaccctggag

SEQ ID NO: 3936 - DNA, 15 bp, Homo sapiens
tcacttgaccctgga

SEQ ID NO: 3937 - DNA, 15 bp, Homo sapiens
atcacttgaccctgg

SEQ ID NO: 3938 - DNA, 15 bp, Homo sapiens
aatcacttgaccctg

SEQ ID NO: 3939 - DNA, 15 bp, Homo sapiens
gaatcacttgaccct

SEQ ID NO: 3940 - DNA, 15 bp, Homo sapiens
agaatcacttgaccc

SEQ ID NO: 3941 - DNA, 15 bp, Homo sapiens
gagaatcacttgacc

SEQ ID NO: 3942 - DNA, 15 bp, Homo sapiens
ggagaatcacttgac

SEQ ID NO: 3943 - DNA, 15 bp, Homo sapiens
tggagaatcacttga

SEQ ID NO: 3944 - DNA, 15 bp, Homo sapiens
ctggagaatcacttg

SEQ ID NO: 3945 - DNA, 15 bp, Homo sapiens
gctggagaatcactt

SEQ ID NO: 3946 - DNA, 15 bp, Homo sapiens
ggctggagaatcact

SEQ ID NO: 3947 - DNA, 15 bp, Homo sapiens
aggctggagaatcac

SEQ ID NO: 3948 - DNA, 15 bp, Homo sapiens
gaggctggagaatca

SEQ ID NO: 3949 - DNA, 15 bp, Homo sapiens
ggctgaggctggaga

SEQ ID NO: 3950 - DNA, 15 bp, Homo sapiens
aggctgaggctggag

SEQ ID NO: 3951 - DNA, 15 bp, Homo sapiens
gaggctgaggctgga

SEQ ID NO: 3952 - DNA, 15 bp, Homo sapiens
ggaggctgaggctgg

SEQ ID NO: 3953 - DNA, 15 bp, Homo sapiens
aggaggctgaggctg

SEQ ID NO: 3954 - DNA, 15 bp, Homo sapiens
caggaggctgaggct

SEQ ID NO: 3955 - DNA, 15 bp, Homo sapiens
tcaggaggctgaggc

SEQ ID NO: 3956 - DNA, 15 bp, Homo sapiens
ttcaggaggctgagg

SEQ ID NO: 3957 - DNA, 15 bp, Homo sapiens
attcaggaggctgag

SEQ ID NO: 3958 - DNA, 15 bp, Homo sapiens
tattcaggaggctga

SEQ ID NO: 3959 - DNA, 15 bp, Homo sapiens
ctattcaggaggctg

SEQ ID NO: 3960 - DNA, 15 bp, Homo sapiens
gctattcaggaggct

SEQ ID NO: 3961 - DNA, 15 bp, Homo sapiens
agctattcaggaggc

SEQ ID NO: 3962 - DNA, 15 bp, Homo sapiens
cagctattcaggagg

SEQ ID NO: 3963 - DNA, 15 bp, Homo sapiens
ccagctattcaggag

SEQ ID NO: 3964 - DNA, 15 bp, Homo sapiens
cccagctattcagga

SEQ ID NO: 3965 - DNA, 15 bp, Homo sapiens
tcccagctattcagg

SEQ ID NO: 3966 - DNA, 15 bp, Homo sapiens
atcccagctattcag

SEQ ID NO: 3967 - DNA, 15 bp, Homo sapiens
aatcccagctattca

SEQ ID NO: 3968 - DNA, 15 bp, Homo sapiens
taatcccagctattc

SEQ ID NO: 3969 - DNA, 15 bp, Homo sapiens
gtaatcccagctatt

SEQ ID NO: 3970 - DNA, 15 bp, Homo sapiens
tgtaatcccagctat

SEQ ID NO: 3971 - DNA, 15 bp, Homo sapiens
gggcgcctgtaatcc

SEQ ID NO: 3972 - DNA, 15 bp, Homo sapiens
cgggcgcctgtaatc

SEQ ID NO: 3973 - DNA, 15 bp, Homo sapiens
gcgggcgcctgtaat

SEQ ID NO: 3974 - DNA, 15 bp, Homo sapiens
ggcgggcgcctgtaa

SEQ ID NO: 3975 - DNA, 15 bp, Homo sapiens
tggcgggcgcctgta

SEQ ID NO: 3976 - DNA, 15 bp, Homo sapiens
gtggcgggcgcctgt

SEQ ID NO: 3977 - DNA, 15 bp, Homo sapiens
ggtggcgggcgcctg

SEQ ID NO: 3978 - DNA, 15 bp, Homo sapiens
tggtggcgggcgcct

SEQ ID NO: 3979 - DNA, 15 bp, Homo sapiens
gtggtggcgggcgcc

SEQ ID NO: 3980 - DNA, 15 bp, Homo sapiens
cgtggtggcgggcgc

SEQ ID NO: 3981 - DNA, 15 bp, Homo sapiens
gcgtggtggcgggcg

SEQ ID NO: 3982 - DNA, 15 bp, Homo sapiens
ggcgtggtggcgggc

SEQ ID NO: 3983 - DNA, 15 bp, Homo sapiens
gggcgtggtggcggg

SEQ ID NO: 3984 - DNA, 15 bp, Homo sapiens
tgggcgtggtggcgg

SEQ ID NO: 3985 - DNA, 15 bp, Homo sapiens
ctgggcgtggtggcg

SEQ ID NO: 3986 - DNA, 15 bp, Homo sapiens
caccccatctctact

SEQ ID NO: 3987 - DNA, 15 bp, Homo sapiens
ccaccccatctctac

SEQ ID NO: 3988 - DNA, 15 bp, Homo sapiens
cccaccccatctcta

SEQ ID NO: 3989 - DNA, 15 bp, Homo sapiens
ccccaccccatctct

SEQ ID NO: 3990 - DNA, 15 bp, Homo sapiens
accccaccccatctc

SEQ ID NO: 3991 - DNA, 15 bp, Homo sapiens
aaccccaccccatct

SEQ ID NO: 3992 - DNA, 15 bp, Homo sapiens
aaaccccaccccatc

SEQ ID NO: 3993 - DNA, 15 bp, Homo sapiens
gaaaccccaccccat

SEQ ID NO: 3994 - DNA, 15 bp, Homo sapiens
tgaaaccccacccca

SEQ ID NO: 3995 - DNA, 15 bp, Homo sapiens
gtgaaaccccacccc

SEQ ID NO: 3996 - DNA, 15 bp, Homo sapiens
ggtgaaaccccaccc

SEQ ID NO: 3997 - DNA, 15 bp, Homo sapiens
tggtgaaaccccacc

SEQ ID NO: 3998 - DNA, 15 bp, Homo sapiens
atggtgaaaccccac

SEQ ID NO: 3999 - DNA, 15 bp, Homo sapiens
aagaccagcctggcc

SEQ ID NO: 4000 - DNA, 15 bp, Homo sapiens
caagaccagcctggc

SEQ ID NO: 4001 - DNA, 15 bp, Homo sapiens
tcaagaccagcctgg

SEQ ID NO: 4002 - DNA, 15 bp, Homo sapiens
ttcaagaccagcctg

SEQ ID NO: 4003 - DNA, 15 bp, Homo sapiens
gttcaagaccagcct

SEQ ID NO: 4004 - DNA, 15 bp, Homo sapiens
agttcaagaccagcc

SEQ ID NO: 4005 - DNA, 15 bp, Homo sapiens
gagttcaagaccagc

SEQ ID NO: 4006 - DNA, 15 bp, Homo sapiens
ggagttcaagaccag

SEQ ID NO: 4007 - DNA, 15 bp, Homo sapiens
aggagttcaagacca

SEQ ID NO: 4008 - DNA, 15 bp, Homo sapiens
caggagttcaagacc

SEQ ID NO: 4009 - DNA, 15 bp, Homo sapiens
tcaggagttcaagac

SEQ ID NO: 4010 - DNA, 15 bp, Homo sapiens
gtcaggagttcaaga

SEQ ID NO: 4011 - DNA, 15 bp, Homo sapiens
tgtcaggagttcaag

SEQ ID NO: 4012 - DNA, 15 bp, Homo sapiens
atgtcaggagttcaa

SEQ ID NO: 4013 - DNA, 15 bp, Homo sapiens
gatgtcaggagttca

SEQ ID NO: 4014 - DNA, 15 bp, Homo sapiens
tgatgtcaggagttc

SEQ ID NO: 4015 - DNA, 15 bp, Homo sapiens
ttgatgtcaggagtt

SEQ ID NO: 4016 - DNA, 15 bp, Homo sapiens
cttgatgtcaggagt

SEQ ID NO: 4017 - DNA, 15 bp, Homo sapiens
acttgatgtcaggag

SEQ ID NO: 4018 - DNA, 15 bp, Homo sapiens
cacttgatgtcagga

SEQ ID NO: 4019 - DNA, 15 bp, Homo sapiens
acacttgatgtcagg

SEQ ID NO: 4020 - DNA, 15 bp, Homo sapiens
aacacttgatgtcag

SEQ ID NO: 4021 - DNA, 15 bp, Homo sapiens
gaacacttgatgtca

SEQ ID NO: 4022 - DNA, 15 bp, Homo sapiens
agaacacttgatgtc

SEQ ID NO: 4023 - DNA, 15 bp, Homo sapiens
cagaacacttgatgt

SEQ ID NO: 4024 - DNA, 15 bp, Homo sapiens
gcagaacacttgatg

SEQ ID NO: 4025 - DNA, 15 bp, Homo sapiens
agcagaacacttgat

SEQ ID NO: 4026 - DNA, 15 bp, Homo sapiens
gagcagaacacttga

SEQ ID NO: 4027 - DNA, 15 bp, Homo sapiens
tgagcagaacacttg

SEQ ID NO: 4028 - DNA, 15 bp, Homo sapiens
gtgagcagaacactt

SEQ ID NO: 4029 - DNA, 15 bp, Homo sapiens
ggtgagcagaacact

SEQ ID NO: 4030 - DNA, 15 bp, Homo sapiens
aggtgagcagaacac

SEQ ID NO: 4031 - DNA, 15 bp, Homo sapiens
gaggtgagcagaaca

SEQ ID NO: 4032 - DNA, 15 bp, Homo sapiens
tgaggtgagcagaac

SEQ ID NO: 4033 - DNA, 15 bp, Homo sapiens
ctgaggtgagcagaa

SEQ ID NO: 4034 - DNA, 15 bp, Homo sapiens
gctgaggtgagcaga

SEQ ID NO: 4035 - DNA, 15 bp, Homo sapiens
ggctgaggtgagcag

SEQ ID NO: 4036 - DNA, 15 bp, Homo sapiens
aggctgaggtgagca

SEQ ID NO: 4037 - DNA, 15 bp, Homo sapiens
gaggctgaggtgagc

SEQ ID NO: 4038 - DNA, 15 bp, Homo sapiens
agaggctgaggtgag

SEQ ID NO: 4039 - DNA, 15 bp, Homo sapiens
cagaggctgaggtga

SEQ ID NO: 4040 - DNA, 15 bp, Homo sapiens
tcagaggctgaggtg

SEQ ID NO: 4041 - DNA, 15 bp, Homo sapiens
ttcagaggctgaggt

SEQ ID NO: 4042 - DNA, 15 bp, Homo sapiens
tttcagaggctgagg

SEQ ID NO: 4043 - DNA, 15 bp, Homo sapiens
ctttcagaggctgag

SEQ ID NO: 4044 - DNA, 15 bp, Homo sapiens
actttcagaggctga

SEQ ID NO: 4045 - DNA, 15 bp, Homo sapiens
cactttcagaggctg

SEQ ID NO: 4046 - DNA, 15 bp, Homo sapiens
gcactttcagaggct

SEQ ID NO: 4047 - DNA, 15 bp, Homo sapiens
agcactttcagaggc

SEQ ID NO: 4048 - DNA, 15 bp, Homo sapiens
cagcactttcagagg

SEQ ID NO: 4049 - DNA, 15 bp, Homo sapiens
ccagcactttcagag

SEQ ID NO: 4050 - DNA, 15 bp, Homo sapiens
cccagcactttcaga

SEQ ID NO: 4051 - DNA, 15 bp, Homo sapiens
tcccagcactttcag

SEQ ID NO: 4052 - DNA, 15 bp, Homo sapiens
atcccagcactttca

SEQ ID NO: 4053 - DNA, 15 bp, Homo sapiens
aatcccagcactttc

SEQ ID NO: 4054 - DNA, 15 bp, Homo sapiens
agtggctcacgcctg

SEQ ID NO: 4055 - DNA, 15 bp, Homo sapiens
cagtggctcacgcct

SEQ ID NO: 4056 - DNA, 15 bp, Homo sapiens
gcagtggctcacgcc

SEQ ID NO: 4057 - DNA, 15 bp, Homo sapiens
cgcagtggctcacgc

SEQ ID NO: 4058 - DNA, 15 bp, Homo sapiens
gcgcagtggctcacg

SEQ ID NO: 4059 - DNA, 15 bp, Homo sapiens
ggcgcagtggctcac

SEQ ID NO: 4060 - DNA, 15 bp, Homo sapiens
gggcgcagtggctca

SEQ ID NO: 4061 - DNA, 15 bp, Homo sapiens
cgggcgcagtggctc

SEQ ID NO: 4062 - DNA, 15 bp, Homo sapiens
ccgggcgcagtggct

SEQ ID NO: 4063 - DNA, 15 bp, Homo sapiens
gccgggcgcagtggc

SEQ ID NO: 4064 - DNA, 15 bp, Homo sapiens
tgccgggcgcagtgg

SEQ ID NO: 4065 - DNA, 15 bp, Homo sapiens
ctgccgggcgcagtg

SEQ ID NO: 4066 - DNA, 15 bp, Homo sapiens
actgccgggcgcagt

SEQ ID NO: 4067 - DNA, 15 bp, Homo sapiens
gactgccgggcgcag

SEQ ID NO: 4068 - DNA, 15 bp, Homo sapiens
agactgccgggcgca

SEQ ID NO: 4069 - DNA, 15 bp, Homo sapiens
aagactgccgggcgc

SEQ ID NO: 4070 - DNA, 15 bp, Homo sapiens
aaagactgccgggcg

SEQ ID NO: 4071 - DNA, 15 bp, Homo sapiens
gaaagactgccgggc

SEQ ID NO: 4072 - DNA, 15 bp, Homo sapiens
ggaaagactgccggg

SEQ ID NO: 4073 - DNA, 15 bp, Homo sapiens
aggaaagactgccgg

SEQ ID NO: 4074 - DNA, 15 bp, Homo sapiens
aaggaaagactgccg

SEQ ID NO: 4075 - DNA, 15 bp, Homo sapiens
gaaggaaagactgcc

SEQ ID NO: 4076 - DNA, 15 bp, Homo sapiens
agaaggaaagactgc

SEQ ID NO: 4077 - DNA, 15 bp, Homo sapiens
aagaaggaaagactg

SEQ ID NO: 4078 - DNA, 15 bp, Homo sapiens
aaagaaggaaagact

SEQ ID NO: 4079 - DNA, 15 bp, Homo sapiens
aaaagaaggaaagac

SEQ ID NO: 4080 - DNA, 15 bp, Homo sapiens
aaaaagaaggaaaga

SEQ ID NO: 4081 - DNA, 15 bp, Homo sapiens
aaaaaagaaggaaag

SEQ ID NO: 4082 - DNA, 15 bp, Homo sapiens
aaaaaaagaaggaaa

SEQ ID NO: 4083 - DNA, 15 bp, Homo sapiens
aaaaaaaagaaggaa

SEQ ID NO: 4084 - DNA, 15 bp, Homo sapiens
aaaaaaaaagaagga

SEQ ID NO: 4085 - DNA, 15 bp, Homo sapiens
aaaaaaaaaagaagg

SEQ ID NO: 4086 - DNA, 15 bp, Homo sapiens
aaaaaaaaaaagaag

SEQ ID NO: 4087 - DNA, 15 bp, Homo sapiens
aaaaaaaaaaaagaa

SEQ ID NO: 4088 - DNA, 15 bp, Homo sapiens
aaaaaaaaaaaaaga

SEQ ID NO: 4089 - DNA, 15 bp, Homo sapiens
taaaaaaaaaaaaaa

SEQ ID NO: 4090 - DNA, 15 bp, Homo sapiens
ttaaaaaaaaaaaaa

SEQ ID NO: 4091 - DNA, 15 bp, Homo sapiens
attaaaaaaaaaaaa

SEQ ID NO: 4092 - DNA, 15 bp, Homo sapiens
cattaaaaaaaaaaa

SEQ ID NO: 4093 - DNA, 15 bp, Homo sapiens
tcattaaaaaaaaaa

SEQ ID NO: 4094 - DNA, 15 bp, Homo sapiens
gtcattaaaaaaaaa

SEQ ID NO: 4095 - DNA, 15 bp, Homo sapiens
tgtcattaaaaaaaa

SEQ ID NO: 4096 - DNA, 15 bp, Homo sapiens
atgtcattaaaaaaa

SEQ ID NO: 4097 - DNA, 15 bp, Homo sapiens
catgtcattaaaaaa

SEQ ID NO: 4098 - DNA, 15 bp, Homo sapiens
ccatgtcattaaaaa

SEQ ID NO: 4099 - DNA, 15 bp, Homo sapiens
cccatgtcattaaaa

SEQ ID NO: 4100 - DNA, 15 bp, Homo sapiens
ccccatgtcattaaa

SEQ ID NO: 4101 - DNA, 15 bp, Homo sapiens
accccatgtcattaa

SEQ ID NO: 4102 - DNA, 15 bp, Homo sapiens
gaccccatgtcatta

SEQ ID NO: 4103 - DNA, 15 bp, Homo sapiens
agaccccatgtcatt

SEQ ID NO: 4104 - DNA, 15 bp, Homo sapiens
aagaccccatgtcat

SEQ ID NO: 4105 - DNA, 15 bp, Homo sapiens
taagaccccatgtca

SEQ ID NO: 4106 - DNA, 15 bp, Homo sapiens
gtaagaccccatgtc

SEQ ID NO: 4107 - DNA, 15 bp, Homo sapiens
agtaagaccccatgt

SEQ ID NO: 4108 - DNA, 15 bp, Homo sapiens
aagtaagaccccatg

SEQ ID NO: 4109 - DNA, 15 bp, Homo sapiens
aaagtaagaccccat

SEQ ID NO: 4110 - DNA, 15 bp, Homo sapiens
taaagtaagacccca

SEQ ID NO: 4111 - DNA, 15 bp, Homo sapiens
ataaagtaagacccc

SEQ ID NO: 4112 - DNA, 15 bp, Homo sapiens
aataaagtaagaccc

SEQ ID NO: 4113 - DNA, 15 bp, Homo sapiens
taataaagtaagacc

SEQ ID NO: 4114 - DNA, 15 bp, Homo sapiens
gtaataaagtaagac

SEQ ID NO: 4115 - DNA, 15 bp, Homo sapiens
agtaataaagtaaga

SEQ ID NO: 4116 - DNA, 15 bp, Homo sapiens
gagtaataaagtaag

SEQ ID NO: 4117 - DNA, 15 bp, Homo sapiens
tgagtaataaagtaa

SEQ ID NO: 4118 - DNA, 15 bp, Homo sapiens
ctgagtaataaagta

SEQ ID NO: 4119 - DNA, 15 bp, Homo sapiens
cctgagtaataaagt

SEQ ID NO: 4120 - DNA, 15 bp, Homo sapiens
gcctgagtaataaag

SEQ ID NO: 4121 - DNA, 15 bp, Homo sapiens
agcctgagtaataaa

SEQ ID NO: 4122 - DNA, 15 bp, Homo sapiens
cagcctgagtaataa

SEQ ID NO: 4123 - DNA, 15 bp, Homo sapiens
ccagcctgagtaata

SEQ ID NO: 4124 - DNA, 15 bp, Homo sapiens
accagcctgagtaat

SEQ ID NO: 4125 - DNA, 15 bp, Homo sapiens
gaccagcctgagtaa

SEQ ID NO: 4126 - DNA, 15 bp, Homo sapiens
agaccagcctgagta

SEQ ID NO: 4127 - DNA, 15 bp, Homo sapiens
gagaccagcctgagt

SEQ ID NO: 4128 - DNA, 15 bp, Homo sapiens
tgagaccagcctgag

SEQ ID NO: 4129 - DNA, 15 bp, Homo sapiens
ttgagaccagcctga

SEQ ID NO: 4130 - DNA, 15 bp, Homo sapiens
tttgagaccagcctg

SEQ ID NO: 4131 - DNA, 15 bp, Homo sapiens
gtttgagaccagcct

SEQ ID NO: 4132 - DNA, 15 bp, Homo sapiens
agtttgagaccagcc

SEQ ID NO: 4133 - DNA, 15 bp, Homo sapiens
aagtttgagaccagc

SEQ ID NO: 4134 - DNA, 15 bp, Homo sapiens
gaagtttgagaccag

SEQ ID NO: 4135 - DNA, 15 bp, Homo sapiens
agaagtttgagacca

SEQ ID NO: 4136 - DNA, 15 bp, Homo sapiens
cagaagtttgagacc

SEQ ID NO: 4137 - DNA, 15 bp, Homo sapiens
ccagaagtttgagac

SEQ ID NO: 4138 - DNA, 15 bp, Homo sapiens
gccagaagtttgaga

SEQ ID NO: 4139 - DNA, 15 bp, Homo sapiens
ggccagaagtttgag

SEQ ID NO: 4140 - DNA, 15 bp, Homo sapiens
aggccagaagtttga

SEQ ID NO: 4141 - DNA, 15 bp, Homo sapiens
gaggccagaagtttg

SEQ ID NO: 4142 - DNA, 15 bp, Homo sapiens
tgaggccagaagttt

SEQ ID NO: 4143 - DNA, 15 bp, Homo sapiens
ttgaggccagaagtt

SEQ ID NO: 4144 - DNA, 15 bp, Homo sapiens
cttgaggccagaagt

SEQ ID NO: 4145 - DNA, 15 bp, Homo sapiens
ccttgaggccagaag

SEQ ID NO: 4146 - DNA, 15 bp, Homo sapiens
cccttgaggccagaa

SEQ ID NO: 4147 - DNA, 15 bp, Homo sapiens
tcccttgaggccaga

SEQ ID NO: 4148 - DNA, 15 bp, Homo sapiens
atcccttgaggccag

SEQ ID NO: 4149 - DNA, 15 bp, Homo sapiens
gatcccttgaggcca

SEQ ID NO: 4150 - DNA, 15 bp, Homo sapiens
agatcccttgaggcc

SEQ ID NO: 4151 - DNA, 15 bp, Homo sapiens
aagatcccttgaggc

SEQ ID NO: 4152 - DNA, 15 bp, Homo sapiens
gaagatcccttgagg

SEQ ID NO: 4153 - DNA, 15 bp, Homo sapiens
ggaagatcccttgag

SEQ ID NO: 4154 - DNA, 15 bp, Homo sapiens
gggaagatcccttga

SEQ ID NO: 4155 - DNA, 15 bp, Homo sapiens
tgggaagatcccttg

SEQ ID NO: 4156 - DNA, 15 bp, Homo sapiens
gtgggaagatccctt

SEQ ID NO: 4157 - DNA, 15 bp, Homo sapiens
ggtgggaagatccct

SEQ ID NO: 4158 - DNA, 15 bp, Homo sapiens
aggtgggaagatccc

SEQ ID NO: 4159 - DNA, 15 bp, Homo sapiens
aaggtgggaagatcc

SEQ ID NO: 4160 - DNA, 15 bp, Homo sapiens
caaggtgggaagatc

SEQ ID NO: 4161 - DNA, 15 bp, Homo sapiens
ccaaggtgggaagat

SEQ ID NO: 4162 - DNA, 15 bp, Homo sapiens
gccaaggtgggaaga

SEQ ID NO: 4163 - DNA, 15 bp, Homo sapiens
ggccaaggtgggaag

SEQ ID NO: 4164 - DNA, 15 bp, Homo sapiens
aggccaaggtgggaa

SEQ ID NO: 4165 - DNA, 15 bp, Homo sapiens
gaggccaaggtggga

SEQ ID NO: 4166 - DNA, 15 bp, Homo sapiens
atttgggaggccaag

SEQ ID NO: 4167 - DNA, 15 bp, Homo sapiens
aatttgggaggccaa

SEQ ID NO: 4168 - DNA, 15 bp, Homo sapiens
caatttgggaggcca

SEQ ID NO: 4169 - DNA, 15 bp, Homo sapiens
gcaatttgggaggcc

SEQ ID NO: 4170 - DNA, 15 bp, Homo sapiens
agcaatttgggaggc

SEQ ID NO: 4171 - DNA, 15 bp, Homo sapiens
cagcaatttgggagg

SEQ ID NO: 4172 - DNA, 15 bp, Homo sapiens
ccagcaatttgggag

SEQ ID NO: 4173 - DNA, 15 bp, Homo sapiens
cccagcaatttggga

SEQ ID NO: 4174 - DNA, 15 bp, Homo sapiens
tcccagcaatttggg

SEQ ID NO: 4175 - DNA, 15 bp, Homo sapiens
atcccagcaatttgg

SEQ ID NO: 4176 - DNA, 15 bp, Homo sapiens
aatcccagcaatttg

SEQ ID NO: 4177 - DNA, 15 bp, Homo sapiens
taatcccagcaattt

SEQ ID NO: 4178 - DNA, 15 bp, Homo sapiens
gtaatcccagcaatt

SEQ ID NO: 4179 - DNA, 15 bp, Homo sapiens
tgtaatcccagcaat

SEQ ID NO: 4180 - DNA, 15 bp, Homo sapiens
ctgtaatcccagcaa

SEQ ID NO: 4181 - DNA, 15 bp, Homo sapiens
atgcctgtaatccca

SEQ ID NO: 4182 - DNA, 15 bp, Homo sapiens
tatgcctgtaatccc

SEQ ID NO: 4183 - DNA, 15 bp, Homo sapiens
ttatgcctgtaatcc

SEQ ID NO: 4184 - DNA, 15 bp, Homo sapiens
cttatgcctgtaatc

SEQ ID NO: 4185 - DNA, 15 bp, Homo sapiens
acttatgcctgtaat

SEQ ID NO: 4186 - DNA, 15 bp, Homo sapiens
gacttatgcctgtaa

SEQ ID NO: 4187 - DNA, 15 bp, Homo sapiens
tgacttatgcctgta

SEQ ID NO: 4188 - DNA, 15 bp, Homo sapiens
atgacttatgcctgt

SEQ ID NO: 4189 - DNA, 15 bp, Homo sapiens
gatgacttatgcctg

SEQ ID NO: 4190 - DNA, 15 bp, Homo sapiens
tgatgacttatgcct

SEQ ID NO: 4191 - DNA, 15 bp, Homo sapiens
atgatgacttatgcc

SEQ ID NO: 4192 - DNA, 15 bp, Homo sapiens
catgatgacttatgc

SEQ ID NO: 4193 - DNA, 15 bp, Homo sapiens
gcatgatgacttatg

SEQ ID NO: 4194 - DNA, 15 bp, Homo sapiens
ggcatgatgacttat

SEQ ID NO: 4195 - DNA, 15 bp, Homo sapiens
aggcatgatgactta

SEQ ID NO: 4196 - DNA, 15 bp, Homo sapiens
caggcatgatgactt

SEQ ID NO: 4197 - DNA, 15 bp, Homo sapiens
ccaggcatgatgact

SEQ ID NO: 4198 - DNA, 15 bp, Homo sapiens
gccaggcatgatgac

SEQ ID NO: 4199 - DNA, 15 bp, Homo sapiens
agccaggcatgatga

SEQ ID NO: 4200 - DNA, 15 bp, Homo sapiens
tagccaggcatgatg

SEQ ID NO: 4201 - DNA, 15 bp, Homo sapiens
gtagccaggcatgat

SEQ ID NO: 4202 - DNA, 15 bp, Homo sapiens
tgtagccaggcatga

SEQ ID NO: 4203 - DNA, 15 bp, Homo sapiens
ttgtagccaggcatg

SEQ ID NO: 4204 - DNA, 15 bp, Homo sapiens
tttgtagccaggcat

SEQ ID NO: 4205 - DNA, 15 bp, Homo sapiens
gtttgtagccaggca

SEQ ID NO: 4206 - DNA, 15 bp, Homo sapiens
tgtttgtagccaggc

SEQ ID NO: 4207 - DNA, 15 bp, Homo sapiens
ctgtttgtagccagg

SEQ ID NO: 4208 - DNA, 15 bp, Homo sapiens
tctgtttgtagccag

SEQ ID NO: 4209 - DNA, 15 bp, Homo sapiens
atctgtttgtagcca

SEQ ID NO: 4210 - DNA, 15 bp, Homo sapiens
tatctgtttgtagcc

SEQ ID NO: 4211 - DNA, 15 bp, Homo sapiens
atatctgtttgtagc

SEQ ID NO: 4212 - DNA, 15 bp, Homo sapiens
aatatctgtttgtag

SEQ ID NO: 4213 - DNA, 15 bp, Homo sapiens
aaatatctgtttgta

SEQ ID NO: 4214 - DNA, 15 bp, Homo sapiens
aaaatatctgtttgt

SEQ ID NO: 4215 - DNA, 15 bp, Homo sapiens
gaaaatatctgtttg

SEQ ID NO: 4216 - DNA, 15 bp, Homo sapiens
tgaaaatatctgttt

SEQ ID NO: 4217 - DNA, 15 bp, Homo sapiens
ttgaaaatatctgtt

SEQ ID NO: 4218 - DNA, 15 bp, Homo sapiens
attgaaaatatctgt

SEQ ID NO: 4219 - DNA, 15 bp, Homo sapiens
tattgaaaatatctg

SEQ ID NO: 4220 - DNA, 15 bp, Homo sapiens
ttattgaaaatatct

SEQ ID NO: 4221 - DNA, 15 bp, Homo sapiens
cttattgaaaatatc

SEQ ID NO: 4222 - DNA, 15 bp, Homo sapiens
tcttattgaaaatat

SEQ ID NO: 4223 - DNA, 15 bp, Homo sapiens
ctcttattgaaaata

SEQ ID NO: 4224 - DNA, 15 bp, Homo sapiens
cctcttattgaaaat

SEQ ID NO: 4225 - DNA, 15 bp, Homo sapiens
tcctcttattgaaaa

SEQ ID NO: 4226 - DNA, 15 bp, Homo sapiens
atcctcttattgaaa

SEQ ID NO: 4227 - DNA, 15 bp, Homo sapiens
tatcctcttattgaa

SEQ ID NO: 4228 - DNA, 15 bp, Homo sapiens
ttatcctcttattga

SEQ ID NO: 4229 - DNA, 15 bp, Homo sapiens
tttatcctcttattg

SEQ ID NO: 4230 - DNA, 15 bp, Homo sapiens
ttttatcctcttatt

SEQ ID NO: 4231 - DNA, 15 bp, Homo sapiens
cttttatcctcttat

SEQ ID NO: 4232 - DNA, 15 bp, Homo sapiens
acttttatcctctta

SEQ ID NO: 4233 - DNA, 15 bp, Homo sapiens
aacttttatcctctt

SEQ ID NO: 4234 - DNA, 15 bp, Homo sapiens
gaacttttatcctct

SEQ ID NO: 4235 - DNA, 15 bp, Homo sapiens
tgaacttttatcctc

SEQ ID NO: 4236 - DNA, 15 bp, Homo sapiens
atgaacttttatcct

SEQ ID NO: 4237 - DNA, 15 bp, Homo sapiens
aatgaacttttatcc

SEQ ID NO: 4238 - DNA, 15 bp, Homo sapiens
aaatgaacttttatc

SEQ ID NO: 4239 - DNA, 15 bp, Homo sapiens
gaaatgaacttttat

SEQ ID NO: 4240 - DNA, 15 bp, Homo sapiens
ggaaatgaactttta

SEQ ID NO: 4241 - DNA, 15 bp, Homo sapiens
gggaaatgaactttt

SEQ ID NO: 4242 - DNA, 15 bp, Homo sapiens
ggggaaatgaacttt

SEQ ID NO: 4243 - DNA, 15 bp, Homo sapiens
tggggaaatgaactt

SEQ ID NO: 4244 - DNA, 15 bp, Homo sapiens
atggggaaatgaact

SEQ ID NO: 4245 - DNA, 15 bp, Homo sapiens
tatggggaaatgaac

SEQ ID NO: 4246 - DNA, 15 bp, Homo sapiens
gtatggggaaatgaa

SEQ ID NO: 4247 - DNA, 15 bp, Homo sapiens
agtatggggaaatga

SEQ ID NO: 4248 - DNA, 15 bp, Homo sapiens
aagtatggggaaatg

SEQ ID NO: 4249 - DNA, 15 bp, Homo sapiens
aaagtatggggaaat

SEQ ID NO: 4250 - DNA, 15 bp, Homo sapiens
caaagtatggggaaa

SEQ ID NO: 4251 - DNA, 15 bp, Homo sapiens
gcaaagtatggggaa

SEQ ID NO: 4252 - DNA, 15 bp, Homo sapiens
agcaaagtatgggga

SEQ ID NO: 4253 - DNA, 15 bp, Homo sapiens
tagcaaagtatgggg

SEQ ID NO: 4254 - DNA, 15 bp, Homo sapiens
ttagcaaagtatggg

SEQ ID NO: 4255 - DNA, 15 bp, Homo sapiens
gttagcaaagtatgg

SEQ ID NO: 4256 - DNA, 15 bp, Homo sapiens
tgttagcaaagtatg

SEQ ID NO: 4257 - DNA, 15 bp, Homo sapiens
atgttagcaaagtat

SEQ ID NO: 4258 - DNA, 15 bp, Homo sapiens
gatgttagcaaagta

SEQ ID NO: 4259 - DNA, 15 bp, Homo sapiens
tgatgttagcaaagt

SEQ ID NO: 4260 - DNA, 15 bp, Homo sapiens
ttgatgttagcaaag

SEQ ID NO: 4261 - DNA, 15 bp, Homo sapiens
tttgatgttagcaaa

SEQ ID NO: 4262 - DNA, 15 bp, Homo sapiens
atttgatgttagcaa

SEQ ID NO: 4263 - DNA, 15 bp, Homo sapiens
catttgatgttagca

SEQ ID NO: 4264 - DNA, 15 bp, Homo sapiens
acatttgatgttagc

SEQ ID NO: 4265 - DNA, 15 bp, Homo sapiens
aacatttgatgttag

SEQ ID NO: 4266 - DNA, 15 bp, Homo sapiens
taacatttgatgtta

SEQ ID NO: 4267 - DNA, 15 bp, Homo sapiens
ataacatttgatgtt

SEQ ID NO: 4268 - DNA, 15 bp, Homo sapiens
aataacatttgatgt

SEQ ID NO: 4269 - DNA, 15 bp, Homo sapiens
taataacatttgatg

SEQ ID NO: 4270 - DNA, 15 bp, Homo sapiens
ttaataacatttgat

SEQ ID NO: 4271 - DNA, 15 bp, Homo sapiens
attaataacatttga

SEQ ID NO: 4272 - DNA, 15 bp, Homo sapiens
aattaataacatttg

SEQ ID NO: 4273 - DNA, 15 bp, Homo sapiens
gaattaataacattt

SEQ ID NO: 4274 - DNA, 15 bp, Homo sapiens
ggaattaataacatt

SEQ ID NO: 4275 - DNA, 15 bp, Homo sapiens
aggaattaataacat

SEQ ID NO: 4276 - DNA, 15 bp, Homo sapiens
taggaattaataaca

SEQ ID NO: 4277 - DNA, 15 bp, Homo sapiens
ttaggaattaataac

SEQ ID NO: 4278 - DNA, 15 bp, Homo sapiens
attaggaattaataa

SEQ ID NO: 4279 - DNA, 15 bp, Homo sapiens
tattaggaattaata

SEQ ID NO: 4280 - DNA, 15 bp, Homo sapiens
ctattaggaattaat

SEQ ID NO: 4281 - DNA, 15 bp, Homo sapiens
actattaggaattaa

SEQ ID NO: 4282 - DNA, 15 bp, Homo sapiens
aactattaggaatta

SEQ ID NO: 4283 - DNA, 15 bp, Homo sapiens
aaactattaggaatt

SEQ ID NO: 4284 - DNA, 15 bp, Homo sapiens
aaaactattaggaat

SEQ ID NO: 4285 - DNA, 15 bp, Homo sapiens
caaaactattaggaa

SEQ ID NO: 4286 - DNA, 15 bp, Homo sapiens
gcaaaactattagga

SEQ ID NO: 4287 - DNA, 15 bp, Homo sapiens
ggcaaaactattagg

SEQ ID NO: 4288 - DNA, 15 bp, Homo sapiens
tggcaaaactattag

SEQ ID NO: 4289 - DNA, 15 bp, Homo sapiens
ttggcaaaactatta

SEQ ID NO: 4290 - DNA, 15 bp, Homo sapiens
tttggcaaaactatt

SEQ ID NO: 4291 - DNA, 15 bp, Homo sapiens
gtttggcaaaactat

SEQ ID NO: 4292 - DNA, 15 bp, Homo sapiens
agtttggcaaaacta

SEQ ID NO: 4293 - DNA, 15 bp, Homo sapiens
cagtttggcaaaact

SEQ ID NO: 4294 - DNA, 15 bp, Homo sapiens
tcagtttggcaaaac

SEQ ID NO: 4295 - DNA, 15 bp, Homo sapiens
ctcagtttggcaaaa

SEQ ID NO: 4296 - DNA, 15 bp, Homo sapiens
tctcagtttggcaaa

SEQ ID NO: 4297 - DNA, 15 bp, Homo sapiens
ctctcagtttggcaa

SEQ ID NO: 4298 - DNA, 15 bp, Homo sapiens
cctctcagtttggca

SEQ ID NO: 4299 - DNA, 15 bp, Homo sapiens
tcctctcagtttggc

SEQ ID NO: 4300 - DNA, 15 bp, Homo sapiens
ttcctctcagtttgg

SEQ ID NO: 4301 - DNA, 15 bp, Homo sapiens
tttcctctcagtttg

SEQ ID NO: 4302 - DNA, 15 bp, Homo sapiens
ttttcctctcagttt

SEQ ID NO: 4303 - DNA, 15 bp, Homo sapiens
attttcctctcagtt

SEQ ID NO: 4304 - DNA, 15 bp, Homo sapiens
cattttcctctcagt

SEQ ID NO: 4305 - DNA, 15 bp, Homo sapiens
ccattttcctctcag

SEQ ID NO: 4306 - DNA, 15 bp, Homo sapiens
accattttcctctca

SEQ ID NO: 4307 - DNA, 15 bp, Homo sapiens
taccattttcctctc

SEQ ID NO: 4308 - DNA, 15 bp, Homo sapiens
ataccattttcctct

SEQ ID NO: 4309 - DNA, 15 bp, Homo sapiens
cataccattttcctc

SEQ ID NO: 4310 - DNA, 15 bp, Homo sapiens
acataccattttcct

SEQ ID NO: 4311 - DNA, 15 bp, Homo sapiens
aacataccattttcc

SEQ ID NO: 4312 - DNA, 15 bp, Homo sapiens
taacataccattttc

SEQ ID NO: 4313 - DNA, 15 bp, Homo sapiens
ctaacataccatttt

SEQ ID NO: 4314 - DNA, 15 bp, Homo sapiens
actaacataccattt

SEQ ID NO: 4315 - DNA, 15 bp, Homo sapiens
aactaacataccatt

SEQ ID NO: 4316 - DNA, 15 bp, Homo sapiens
aaactaacataccat

SEQ ID NO: 4317 - DNA, 15 bp, Homo sapiens
aaaactaacatacca

SEQ ID NO: 4318 - DNA, 15 bp, Homo sapiens
aaaaactaacatacc

SEQ ID NO: 4319 - DNA, 15 bp, Homo sapiens
gaaaaactaacatac

SEQ ID NO: 4320 - DNA, 15 bp, Homo sapiens
agaaaaactaacata

SEQ ID NO: 4321 - DNA, 15 bp, Homo sapiens
cagaaaaactaacat

SEQ ID NO: 4322 - DNA, 15 bp, Homo sapiens
ccagaaaaactaaca

SEQ ID NO: 4323 - DNA, 15 bp, Homo sapiens
cccagaaaaactaac

SEQ ID NO: 4324 - DNA, 15 bp, Homo sapiens
acccagaaaaactaa

SEQ ID NO: 4325 - DNA, 15 bp, Homo sapiens
aacccagaaaaacta

SEQ ID NO: 4326 - DNA, 15 bp, Homo sapiens
aaacccagaaaaact

SEQ ID NO: 4327 - DNA, 15 bp, Homo sapiens
aaaacccagaaaaac

SEQ ID NO: 4328 - DNA, 15 bp, Homo sapiens
gaaaacccagaaaaa

SEQ ID NO: 4329 - DNA, 15 bp, Homo sapiens
agaaaacccagaaaa

SEQ ID NO: 4330 - DNA, 15 bp, Homo sapiens
aagaaaacccagaaa

SEQ ID NO: 4331 - DNA, 15 bp, Homo sapiens
aaagaaaacccagaa

SEQ ID NO: 4332 - DNA, 15 bp, Homo sapiens
gaaagaaaacccaga

SEQ ID NO: 4333 - DNA, 15 bp, Homo sapiens
agaaagaaaacccag

SEQ ID NO: 4334 - DNA, 15 bp, Homo sapiens
aagaaagaaaaccca

SEQ ID NO: 4335 - DNA, 15 bp, Homo sapiens
aaagaaagaaaaccc

SEQ ID NO: 4336 - DNA, 15 bp, Homo sapiens
aaaagaaagaaaacc

SEQ ID NO: 4337 - DNA, 15 bp, Homo sapiens
aaaaagaaagaaaac

SEQ ID NO: 4338 - DNA, 15 bp, Homo sapiens
taaaaagaaagaaaa

SEQ ID NO: 4339 - DNA, 15 bp, Homo sapiens
ttaaaaagaaagaaa

SEQ ID NO: 4340 - DNA, 15 bp, Homo sapiens
attaaaaagaaagaa

SEQ ID NO: 4341 - DNA, 15 bp, Homo sapiens
aattaaaaagaaaga

SEQ ID NO: 4342 - DNA, 15 bp, Homo sapiens
aaattaaaaagaaag

SEQ ID NO: 4343 - DNA, 15 bp, Homo sapiens
aaaattaaaaagaaa

SEQ ID NO: 4344 - DNA, 15 bp, Homo sapiens
aaaaattaaaaagaa

SEQ ID NO: 4345 - DNA, 15 bp, Homo sapiens
aaaaaattaaaaaga

SEQ ID NO: 4346 - DNA, 15 bp, Homo sapiens
aaaaaaattaaaaag

SEQ ID NO: 4347 - DNA, 15 bp, Homo sapiens
aaaaaaaattaaaaa

SEQ ID NO: 4348 - DNA, 15 bp, Homo sapiens
gaaaaaaaattaaaa

SEQ ID NO: 4349 - DNA, 15 bp, Homo sapiens
agaaaaaaaattaaa

SEQ ID NO: 4350 - DNA, 15 bp, Homo sapiens
aagaaaaaaaattaa

SEQ ID NO: 4351 - DNA, 15 bp, Homo sapiens
aaagaaaaaaaatta

SEQ ID NO: 4352 - DNA, 15 bp, Homo sapiens
aaaagaaaaaaaatt

SEQ ID NO: 4353 - DNA, 15 bp, Homo sapiens
aaaaagaaaaaaaat

SEQ ID NO: 4354 - DNA, 15 bp, Homo sapiens
aaaaaagaaaaaaaa

SEQ ID NO: 4355 - DNA, 15 bp, Homo sapiens
taaaaaagaaaaaaa

SEQ ID NO: 4356 - DNA, 15 bp, Homo sapiens
ataaaaaagaaaaaa

SEQ ID NO: 4357 - DNA, 15 bp, Homo sapiens
aataaaaaagaaaaa

SEQ ID NO: 4358 - DNA, 15 bp, Homo sapiens
gaataaaaaagaaaa

SEQ ID NO: 4359 - DNA, 15 bp, Homo sapiens
tgaataaaaaagaaa

SEQ ID NO: 4360 - DNA, 15 bp, Homo sapiens
atgaataaaaaagaa

SEQ ID NO: 4361 - DNA, 15 bp, Homo sapiens
gatgaataaaaaaga

SEQ ID NO: 4362 - DNA, 15 bp, Homo sapiens
cgatgaataaaaaag

SEQ ID NO: 4363 - DNA, 15 bp, Homo sapiens
gcgatgaataaaaaa

SEQ ID NO: 4364 - DNA, 15 bp, Homo sapiens
tgcgatgaataaaaa

SEQ ID NO: 4365 - DNA, 15 bp, Homo sapiens
ttgcgatgaataaaa

SEQ ID NO: 4366 - DNA, 15 bp, Homo sapiens
gttgcgatgaataaa

SEQ ID NO: 4367 - DNA, 15 bp, Homo sapiens
tgttgcgatgaataa

SEQ ID NO: 4368 - DNA, 15 bp, Homo sapiens
gtgttgcgatgaata

SEQ ID NO: 4369 - DNA, 15 bp, Homo sapiens
agtgttgcgatgaat

SEQ ID NO: 4370 - DNA, 15 bp, Homo sapiens
tagtgttgcgatgaa

SEQ ID NO: 4371 - DNA, 15 bp, Homo sapiens
atagtgttgcgatga

SEQ ID NO: 4372 - DNA, 15 bp, Homo sapiens
aatagtgttgcgatg

SEQ ID NO: 4373 - DNA, 15 bp, Homo sapiens
gaatagtgttgcgat

SEQ ID NO: 4374 - DNA, 15 bp, Homo sapiens
tgaatagtgttgcga

SEQ ID NO: 4375 - DNA, 15 bp, Homo sapiens
gtgaatagtgttgcg

SEQ ID NO: 4376 - DNA, 15 bp, Homo sapiens
cgtgaatagtgttgc

SEQ ID NO: 4377 - DNA, 15 bp, Homo sapiens
tcgtgaatagtgttg

SEQ ID NO: 4378 - DNA, 15 bp, Homo sapiens
atcgtgaatagtgtt

SEQ ID NO: 4379 - DNA, 15 bp, Homo sapiens
aatcgtgaatagtgt

SEQ ID NO: 4380 - DNA, 15 bp, Homo sapiens
aaatcgtgaatagtg

SEQ ID NO: 4381 - DNA, 15 bp, Homo sapiens
aaaatcgtgaatagt

SEQ ID NO: 4382 - DNA, 15 bp, Homo sapiens
aaaaatcgtgaatag

SEQ ID NO: 4383 - DNA, 15 bp, Homo sapiens
aaaaaatcgtgaata

SEQ ID NO: 4384 - DNA, 15 bp, Homo sapiens
aaaaaaatcgtgaat

SEQ ID NO: 4385 - DNA, 15 bp, Homo sapiens
taaaaaaatcgtgaa

SEQ ID NO: 4386 - DNA, 15 bp, Homo sapiens
ataaaaaaatcgtga

SEQ ID NO: 4387 - DNA, 15 bp, Homo sapiens
aataaaaaaatcgtg

SEQ ID NO: 4388 - DNA, 15 bp, Homo sapiens
aaataaaaaaatcgt

SEQ ID NO: 4389 - DNA, 15 bp, Homo sapiens
aaaataaaaaaatcg

SEQ ID NO: 4390 - DNA, 15 bp, Homo sapiens
aaaaataaaaaaatc

SEQ ID NO: 4391 - DNA, 15 bp, Homo sapiens
aaaaaataaaaaaat

SEQ ID NO: 4392 - DNA, 15 bp, Homo sapiens
taaaaaataaaaaaa

SEQ ID NO: 4393 - DNA, 15 bp, Homo sapiens
ataaaaaataaaaaa

SEQ ID NO: 4394 - DNA, 15 bp, Homo sapiens
aataaaaaataaaaa

SEQ ID NO: 4395 - DNA, 15 bp, Homo sapiens
aaataaaaaataaaa

SEQ ID NO: 4396 - DNA, 15 bp, Homo sapiens
aaaataaaaaataaa

SEQ ID NO: 4397 - DNA, 15 bp, Homo sapiens
taaaataaaaaataa

SEQ ID NO: 4398 - DNA, 15 bp, Homo sapiens
ataaaataaaaaata

SEQ ID NO: 4399 - DNA, 15 bp, Homo sapiens
aataaaataaaaaat

SEQ ID NO: 4400 - DNA, 15 bp, Homo sapiens
aaataaaataaaaaa

SEQ ID NO: 4401 - DNA, 15 bp, Homo sapiens
taaataaaataaaaa

SEQ ID NO: 4402 - DNA, 15 bp, Homo sapiens
ataaataaaataaaa

SEQ ID NO: 4403 - DNA, 15 bp, Homo sapiens
aataaataaaataaa

SEQ ID NO: 4404 - DNA, 15 bp, Homo sapiens
aaaaaaaaaaataaa

SEQ ID NO: 4405 - DNA, 15 bp, Homo sapiens
aaaaaaaaaaaataa

SEQ ID NO: 4406 - DNA, 15 bp, Homo sapiens
aaaaaaaaaaaaata

SEQ ID NO: 4407 - DNA, 15 bp, Homo sapiens
caaaaaaaaaaaaat

SEQ ID NO: 4408 - DNA, 15 bp, Homo sapiens
ttgtctcaaaaaaaa

SEQ ID NO: 4409 - DNA, 15 bp, Homo sapiens
cttgtctcaaaaaaa

SEQ ID NO: 4410 - DNA, 15 bp, Homo sapiens
ccttgtctcaaaaaa

SEQ ID NO: 4411 - DNA, 15 bp, Homo sapiens
accttgtctcaaaaa

SEQ ID NO: 4412 - DNA, 15 bp, Homo sapiens
gaccttgtctcaaaa

SEQ ID NO: 4413 - DNA, 15 bp, Homo sapiens
agaccttgtctcaaa

SEQ ID NO: 4414 - DNA, 15 bp, Homo sapiens
gagaccttgtctcaa

SEQ ID NO: 4415 - DNA, 15 bp, Homo sapiens
ggagaccttgtctca

SEQ ID NO: 4416 - DNA, 15 bp, Homo sapiens
gggagaccttgtctc

SEQ ID NO: 4417 - DNA, 15 bp, Homo sapiens
agggagaccttgtct

SEQ ID NO: 4418 - DNA, 15 bp, Homo sapiens
tagggagaccttgtc

SEQ ID NO: 4419 - DNA, 15 bp, Homo sapiens
atagggagaccttgt

SEQ ID NO: 4420 - DNA, 15 bp, Homo sapiens
catagggagaccttg

SEQ ID NO: 4421 - DNA, 15 bp, Homo sapiens
acatagggagacctt

SEQ ID NO: 4422 - DNA, 15 bp, Homo sapiens
aacatagggagacct

SEQ ID NO: 4423 - DNA, 15 bp, Homo sapiens
caacatagggagacc

SEQ ID NO: 4424 - DNA, 15 bp, Homo sapiens
gcaacatagggagac

SEQ ID NO: 4425 - DNA, 15 bp, Homo sapiens
ggcaacatagggaga

SEQ ID NO: 4426 - DNA, 15 bp, Homo sapiens
gggcaacatagggag

SEQ ID NO: 4427 - DNA, 15 bp, Homo sapiens
tgggcaacataggga

SEQ ID NO: 4428 - DNA, 15 bp, Homo sapiens
ctgggcaacataggg

SEQ ID NO: 4429 - DNA, 15 bp, Homo sapiens
cctgggcaacatagg

SEQ ID NO: 4430 - DNA, 15 bp, Homo sapiens
gcctgggcaacatag

SEQ ID NO: 4431 - DNA, 15 bp, Homo sapiens
agcctgggcaacata

SEQ ID NO: 4432 - DNA, 15 bp, Homo sapiens
cagcctgggcaacat

SEQ ID NO: 4433 - DNA, 15 bp, Homo sapiens
accagcctgggcaac

SEQ ID NO: 4434 - DNA, 15 bp, Homo sapiens
gaccagcctgggcaa

SEQ ID NO: 4435 - DNA, 15 bp, Homo sapiens
agaccagcctgggca

SEQ ID NO: 4436 - DNA, 15 bp, Homo sapiens
aagaccagcctgggc

SEQ ID NO: 4437 - DNA, 15 bp, Homo sapiens
caagaccagcctggg

SEQ ID NO: 4438 - DNA, 15 bp, Homo sapiens
acaagaccagcctgg

SEQ ID NO: 4439 - DNA, 15 bp, Homo sapiens
tacaagaccagcctg

SEQ ID NO: 4440 - DNA, 15 bp, Homo sapiens
gtacaagaccagcct

SEQ ID NO: 4441 - DNA, 15 bp, Homo sapiens
ggtacaagaccagcc

SEQ ID NO: 4442 - DNA, 15 bp, Homo sapiens
gggtacaagaccagc

SEQ ID NO: 4443 - DNA, 15 bp, Homo sapiens
ggggtacaagaccag

SEQ ID NO: 4444 - DNA, 15 bp, Homo sapiens
aggggtacaagacca

SEQ ID NO: 4445 - DNA, 15 bp, Homo sapiens
caggggtacaagacc

SEQ ID NO: 4446 - DNA, 15 bp, Homo sapiens
ccaggggtacaagac

SEQ ID NO: 4447 - DNA, 15 bp, Homo sapiens
cccaggggtacaaga

SEQ ID NO: 4448 - DNA, 15 bp, Homo sapiens
gcccaggggtacaag

SEQ ID NO: 4449 - DNA, 15 bp, Homo sapiens
agcccaggggtacaa

SEQ ID NO: 4450 - DNA, 15 bp, Homo sapiens
gagcccaggggtaca

SEQ ID NO: 4451 - DNA, 15 bp, Homo sapiens
tgagcccaggggtac

SEQ ID NO: 4452 - DNA, 15 bp, Homo sapiens
ttgagcccaggggta

SEQ ID NO: 4453 - DNA, 15 bp, Homo sapiens
tttgagcccaggggt

SEQ ID NO: 4454 - DNA, 15 bp, Homo sapiens
ctttgagcccagggg

SEQ ID NO: 4455 - DNA, 15 bp, Homo sapiens
cctttgagcccaggg

SEQ ID NO: 4456 - DNA, 15 bp, Homo sapiens
tcctttgagcccagg

SEQ ID NO: 4457 - DNA, 15 bp, Homo sapiens
atcctttgagcccag

SEQ ID NO: 4458 - DNA, 15 bp, Homo sapiens
gatcctttgagccca

SEQ ID NO: 4459 - DNA, 15 bp, Homo sapiens
ggatcctttgagccc

SEQ ID NO: 4460 - DNA, 15 bp, Homo sapiens
aggatcctttgagcc

SEQ ID NO: 4461 - DNA, 15 bp, Homo sapiens
gaggatcctttgagc

SEQ ID NO: 4462 - DNA, 15 bp, Homo sapiens
ggaggatcctttgag

SEQ ID NO: 4463 - DNA, 15 bp, Homo sapiens
aggaggatcctttga

SEQ ID NO: 4464 - DNA, 15 bp, Homo sapiens
caggaggatcctttg

SEQ ID NO: 4465 - DNA, 15 bp, Homo sapiens
gcaggaggatccttt

SEQ ID NO: 4466 - DNA, 15 bp, Homo sapiens
ggcaggaggatcctt

SEQ ID NO: 4467 - DNA, 15 bp, Homo sapiens
aggcaggaggatcct

SEQ ID NO: 4468 - DNA, 15 bp, Homo sapiens
gaggcaggaggatcc

SEQ ID NO: 4469 - DNA, 15 bp, Homo sapiens
tgaggcaggaggatc

SEQ ID NO: 4470 - DNA, 15 bp, Homo sapiens
ctgaggcaggaggat

SEQ ID NO: 4471 - DNA, 15 bp, Homo sapiens
gctgaggcaggagga

SEQ ID NO: 4472 - DNA, 15 bp, Homo sapiens
ggctgaggcaggagg

SEQ ID NO: 4473 - DNA, 15 bp, Homo sapiens
tgggaggctgaggca

SEQ ID NO: 4474 - DNA, 15 bp, Homo sapiens
ttgggaggctgaggc

SEQ ID NO: 4475 - DNA, 15 bp, Homo sapiens
tttgggaggctgagg

SEQ ID NO: 4476 - DNA, 15 bp, Homo sapiens
ctttgggaggctgag

SEQ ID NO: 4477 - DNA, 15 bp, Homo sapiens
actttgggaggctga

SEQ ID NO: 4478 - DNA, 15 bp, Homo sapiens
cactttgggaggctg

SEQ ID NO: 4479 - DNA, 15 bp, Homo sapiens
gcactttgggaggct

SEQ ID NO: 4480 - DNA, 15 bp, Homo sapiens
tagcactttgggagg

SEQ ID NO: 4481 - DNA, 15 bp, Homo sapiens
ctagcactttgggag

SEQ ID NO: 4482 - DNA, 15 bp, Homo sapiens
cctagcactttggga

SEQ ID NO: 4483 - DNA, 15 bp, Homo sapiens
tcctagcactttggg

SEQ ID NO: 4484 - DNA, 15 bp, Homo sapiens
atcctagcactttgg

SEQ ID NO: 4485 - DNA, 15 bp, Homo sapiens
aatcctagcactttg

SEQ ID NO: 4486 - DNA, 15 bp, Homo sapiens
taatcctagcacttt

SEQ ID NO: 4487 - DNA, 15 bp, Homo sapiens
gtaatcctagcactt

SEQ ID NO: 4488 - DNA, 15 bp, Homo sapiens
tgtaatcctagcact

SEQ ID NO: 4489 - DNA, 15 bp, Homo sapiens
ctgtaatcctagcac

SEQ ID NO: 4490 - DNA, 15 bp, Homo sapiens
cctgtaatcctagca

SEQ ID NO: 4491 - DNA, 15 bp, Homo sapiens
gcctgtaatcctagc

SEQ ID NO: 4492 - DNA, 15 bp, Homo sapiens
tgcctgtaatcctag

SEQ ID NO: 4493 - DNA, 15 bp, Homo sapiens
atgcctgtaatccta

SEQ ID NO: 4494 - DNA, 15 bp, Homo sapiens
catgcctgtaatcct

SEQ ID NO: 4495 - DNA, 15 bp, Homo sapiens
tcatgcctgtaatcc

SEQ ID NO: 4496 - DNA, 15 bp, Homo sapiens
ctcatgcctgtaatc

SEQ ID NO: 4497 - DNA, 15 bp, Homo sapiens
actcatgcctgtaat

SEQ ID NO: 4498 - DNA, 15 bp, Homo sapiens
gactcatgcctgtaa

SEQ ID NO: 4499 - DNA, 15 bp, Homo sapiens
tgactcatgcctgta

SEQ ID NO: 4500 - DNA, 15 bp, Homo sapiens
gtgactcatgcctgt

SEQ ID NO: 4501 - DNA, 15 bp, Homo sapiens
ggtgactcatgcctg

SEQ ID NO: 4502 - DNA, 15 bp, Homo sapiens
tggtgactcatgcct

SEQ ID NO: 4503 - DNA, 15 bp, Homo sapiens
gtggtgactcatgcc

SEQ ID NO: 4504 - DNA, 15 bp, Homo sapiens
cgtggtgactcatgc

SEQ ID NO: 4505 - DNA, 15 bp, Homo sapiens
gcgtggtgactcatg

SEQ ID NO: 4506 - DNA, 15 bp, Homo sapiens
gatagagggtagaga

SEQ ID NO: 4507 - DNA, 15 bp, Homo sapiens
ggatagagggtagag

SEQ ID NO: 4508 - DNA, 15 bp, Homo sapiens
aggatagagggtaga

SEQ ID NO: 4509 - DNA, 15 bp, Homo sapiens
aaggatagagggtag

SEQ ID NO: 4510 - DNA, 15 bp, Homo sapiens
gaaggatagagggta

SEQ ID NO: 4511 - DNA, 15 bp, Homo sapiens
tgaaggatagagggt

SEQ ID NO: 4512 - DNA, 15 bp, Homo sapiens
gtgaaggatagaggg

SEQ ID NO: 4513 - DNA, 15 bp, Homo sapiens
ggtgaaggatagagg

SEQ ID NO: 4514 - DNA, 15 bp, Homo sapiens
aggtgaaggatagag

SEQ ID NO: 4515 - DNA, 15 bp, Homo sapiens
gaggtgaaggataga

SEQ ID NO: 4516 - DNA, 15 bp, Homo sapiens
ggaggtgaaggatag

SEQ ID NO: 4517 - DNA, 15 bp, Homo sapiens
gggaggtgaaggata

SEQ ID NO: 4518 - DNA, 15 bp, Homo sapiens
ggggaggtgaaggat

SEQ ID NO: 4519 - DNA, 15 bp, Homo sapiens
tggggaggtgaagga

SEQ ID NO: 4520 - DNA, 15 bp, Homo sapiens
gtggggaggtgaagg

SEQ ID NO: 4521 - DNA, 15 bp, Homo sapiens
agtggggaggtgaag

SEQ ID NO: 4522 - DNA, 15 bp, Homo sapiens
cagtggggaggtgaa

SEQ ID NO: 4523 - DNA, 15 bp, Homo sapiens
tcagtggggaggtga

SEQ ID NO: 4524 - DNA, 15 bp, Homo sapiens
atcagtggggaggtg

SEQ ID NO: 4525 - DNA, 15 bp, Homo sapiens
gatcagtggggaggt

SEQ ID NO: 4526 - DNA, 15 bp, Homo sapiens
tgatcagtggggagg

SEQ ID NO: 4527 - DNA, 15 bp, Homo sapiens
ttgatcagtggggag

SEQ ID NO: 4528 - DNA, 15 bp, Homo sapiens
tttgatcagtgggga

SEQ ID NO: 4529 - DNA, 15 bp, Homo sapiens
ttttgatcagtgggg

SEQ ID NO: 4530 - DNA, 15 bp, Homo sapiens
gttttgatcagtggg

SEQ ID NO: 4531 - DNA, 15 bp, Homo sapiens
cgttttgatcagtgg

SEQ ID NO: 4532 - DNA, 15 bp, Homo sapiens
tcgttttgatcagtg

SEQ ID NO: 4533 - DNA, 15 bp, Homo sapiens
ctcgttttgatcagt

SEQ ID NO: 4534 - DNA, 15 bp, Homo sapiens
tctcgttttgatcag

SEQ ID NO: 4535 - DNA, 15 bp, Homo sapiens
atctcgttttgatca

SEQ ID NO: 4536 - DNA, 15 bp, Homo sapiens
catctcgttttgatc

SEQ ID NO: 4537 - DNA, 15 bp, Homo sapiens
tcatctcgttttgat

SEQ ID NO: 4538 - DNA, 15 bp, Homo sapiens
atcatctcgttttga

SEQ ID NO: 4539 - DNA, 15 bp, Homo sapiens
tatcatctcgttttg

SEQ ID NO: 4540 - DNA, 15 bp, Homo sapiens
ctatcatctcgtttt

SEQ ID NO: 4541 - DNA, 15 bp, Homo sapiens
actatcatctcgttt

SEQ ID NO: 4542 - DNA, 15 bp, Homo sapiens
aactatcatctcgtt

SEQ ID NO: 4543 - DNA, 15 bp, Homo sapiens
aaactatcatctcgt

SEQ ID NO: 4544 - DNA, 15 bp, Homo sapiens
caaactatcatctcg

SEQ ID NO: 4545 - DNA, 15 bp, Homo sapiens
gcaaactatcatctc

SEQ ID NO: 4546 - DNA, 15 bp, Homo sapiens
ggcaaactatcatct

SEQ ID NO: 4547 - DNA, 15 bp, Homo sapiens
gggcaaactatcatc

SEQ ID NO: 4548 - DNA, 15 bp, Homo sapiens
agggcaaactatcat

SEQ ID NO: 4549 - DNA, 15 bp, Homo sapiens
gagggcaaactatca

SEQ ID NO: 4550 - DNA, 15 bp, Homo sapiens
agagggcaaactatc

SEQ ID NO: 4551 - DNA, 15 bp, Homo sapiens
aagagggcaaactat

SEQ ID NO: 4552 - DNA, 15 bp, Homo sapiens
gaagagggcaaacta

SEQ ID NO: 4553 - DNA, 15 bp, Homo sapiens
tgaagagggcaaact

SEQ ID NO: 4554 - DNA, 15 bp, Homo sapiens
ttgaagagggcaaac

SEQ ID NO: 4555 - DNA, 15 bp, Homo sapiens
tttgaagagggcaaa

SEQ ID NO: 4556 - DNA, 15 bp, Homo sapiens
ttttgaagagggcaa

SEQ ID NO: 4557 - DNA, 15 bp, Homo sapiens
cttttgaagagggca

SEQ ID NO: 4558 - DNA, 15 bp, Homo sapiens
tcttttgaagagggc

SEQ ID NO: 4559 - DNA, 15 bp, Homo sapiens
ttcttttgaagaggg

SEQ ID NO: 4560 - DNA, 15 bp, Homo sapiens
tttcttttgaagagg

SEQ ID NO: 4561 - DNA, 15 bp, Homo sapiens
atttcttttgaagag

SEQ ID NO: 4562 - DNA, 15 bp, Homo sapiens
catttcttttgaaga

SEQ ID NO: 4563 - DNA, 15 bp, Homo sapiens
acatttcttttgaag

SEQ ID NO: 4564 - DNA, 15 bp, Homo sapiens
cacatttcttttgaa

SEQ ID NO: 4565 - DNA, 15 bp, Homo sapiens
acacatttcttttga

SEQ ID NO: 4566 - DNA, 15 bp, Homo sapiens
cacacatttcttttg

SEQ ID NO: 4567 - DNA, 15 bp, Homo sapiens
gcacacatttctttt

SEQ ID NO: 4568 - DNA, 15 bp, Homo sapiens
tgcacacatttcttt

SEQ ID NO: 4569 - DNA, 15 bp, Homo sapiens
atgcacacatttctt

SEQ ID NO: 4570 - DNA, 15 bp, Homo sapiens
catgcacacatttct

SEQ ID NO: 4571 - DNA, 15 bp, Homo sapiens
acatgcacacatttc

SEQ ID NO: 4572 - DNA, 15 bp, Homo sapiens
tacatgcacacattt

SEQ ID NO: 4573 - DNA, 15 bp, Homo sapiens
atacatgcacacatt

SEQ ID NO: 4574 - DNA, 15 bp, Homo sapiens
tatacatgcacacat

SEQ ID NO: 4575 - DNA, 15 bp, Homo sapiens
atatacatgcacaca

SEQ ID NO: 4576 - DNA, 15 bp, Homo sapiens
tatatacatgcacac

SEQ ID NO: 4577 - DNA, 15 bp, Homo sapiens
atatatacatgcaca

SEQ ID NO: 4578 - DNA, 15 bp, Homo sapiens
gatatatacatgcac

SEQ ID NO: 4579 - DNA, 15 bp, Homo sapiens
agatatatacatgca

SEQ ID NO: 4580 - DNA, 15 bp, Homo sapiens
aagatatatacatgc

SEQ ID NO: 4581 - DNA, 15 bp, Homo sapiens
aaagatatatacatg

SEQ ID NO: 4582 - DNA, 15 bp, Homo sapiens
caaagatatatacat

SEQ ID NO: 4583 - DNA, 15 bp, Homo sapiens
tcaaagatatataca

SEQ ID NO: 4584 - DNA, 15 bp, Homo sapiens
atcaaagatatatac

SEQ ID NO: 4585 - DNA, 15 bp, Homo sapiens
aatcaaagatatata

SEQ ID NO: 4586 - DNA, 15 bp, Homo sapiens
aaatcaaagatatat

SEQ ID NO: 4587 - DNA, 15 bp, Homo sapiens
gaaatcaaagatata

SEQ ID NO: 4588 - DNA, 15 bp, Homo sapiens
agaaatcaaagatat

SEQ ID NO: 4589 - DNA, 15 bp, Homo sapiens
aagaaatcaaagata

SEQ ID NO: 4590 - DNA, 15 bp, Homo sapiens
aaagaaatcaaagat

SEQ ID NO: 4591 - DNA, 15 bp, Homo sapiens
aaaagaaatcaaaga

SEQ ID NO: 4592 - DNA, 15 bp, Homo sapiens
caaaagaaatcaaag

SEQ ID NO: 4593 - DNA, 15 bp, Homo sapiens
acaaaagaaatcaaa

SEQ ID NO: 4594 - DNA, 15 bp, Homo sapiens
tacaaaagaaatcaa

SEQ ID NO: 4595 - DNA, 15 bp, Homo sapiens
ctacaaaagaaatca

SEQ ID NO: 4596 - DNA, 15 bp, Homo sapiens
actacaaaagaaatc

SEQ ID NO: 4597 - DNA, 15 bp, Homo sapiens
cactacaaaagaaat

SEQ ID NO: 4598 - DNA, 15 bp, Homo sapiens
ccactacaaaagaaa

SEQ ID NO: 4599 - DNA, 15 bp, Homo sapiens
tccactacaaaagaa

SEQ ID NO: 4600 - DNA, 15 bp, Homo sapiens
ttccactacaaaaga

SEQ ID NO: 4601 - DNA, 15 bp, Homo sapiens
tttccactacaaaag

SEQ ID NO: 4602 - DNA, 15 bp, Homo sapiens
ctttccactacaaaa

SEQ ID NO: 4603 - DNA, 15 bp, Homo sapiens
actttccactacaaa

SEQ ID NO: 4604 - DNA, 15 bp, Homo sapiens
aactttccactacaa

SEQ ID NO: 4605 - DNA, 15 bp, Homo sapiens
caactttccactaca

SEQ ID NO: 4606 - DNA, 15 bp, Homo sapiens
ccaactttccactac

SEQ ID NO: 4607 - DNA, 15 bp, Homo sapiens
cccaactttccacta

SEQ ID NO: 4608 - DNA, 15 bp, Homo sapiens
ccccaactttccact

SEQ ID NO: 4609 - DNA, 15 bp, Homo sapiens
tccccaactttccac

SEQ ID NO: 4610 - DNA, 15 bp, Homo sapiens
gtccccaactttcca

SEQ ID NO: 4611 - DNA, 15 bp, Homo sapiens
tgtccccaactttcc

SEQ ID NO: 4612 - DNA, 15 bp, Homo sapiens
ttgtccccaactttc

SEQ ID NO: 4613 - DNA, 15 bp, Homo sapiens
tttgtccccaacttt

SEQ ID NO: 4614 - DNA, 15 bp, Homo sapiens
atttgtccccaactt

SEQ ID NO: 4615 - DNA, 15 bp, Homo sapiens
catttgtccccaact

SEQ ID NO: 4616 - DNA, 15 bp, Homo sapiens
acatttgtccccaac

SEQ ID NO: 4617 - DNA, 15 bp, Homo sapiens
aacatttgtccccaa

SEQ ID NO: 4618 - DNA, 15 bp, Homo sapiens
gaacatttgtcccca

SEQ ID NO: 4619 - DNA, 15 bp, Homo sapiens
agaacatttgtcccc

SEQ ID NO: 4620 - DNA, 15 bp, Homo sapiens
cagaacatttgtccc

SEQ ID NO: 4621 - DNA, 15 bp, Homo sapiens
gcagaacatttgtcc

SEQ ID NO: 4622 - DNA, 15 bp, Homo sapiens
ggcagaacatttgtc

SEQ ID NO: 4623 - DNA, 15 bp, Homo sapiens
tggcagaacatttgt

SEQ ID NO: 4624 - DNA, 15 bp, Homo sapiens
atggcagaacatttg

SEQ ID NO: 4625 - DNA, 15 bp, Homo sapiens
aatggcagaacattt

SEQ ID NO: 4626 - DNA, 15 bp, Homo sapiens
aaatggcagaacatt

SEQ ID NO: 4627 - DNA, 15 bp, Homo sapiens
caaatggcagaacat

SEQ ID NO: 4628 - DNA, 15 bp, Homo sapiens
ccaaatggcagaaca

SEQ ID NO: 4629 - DNA, 15 bp, Homo sapiens
accaaatggcagaac

SEQ ID NO: 4630 - DNA, 15 bp, Homo sapiens
gaccaaatggcagaa

SEQ ID NO: 4631 - DNA, 15 bp, Homo sapiens
tgaccaaatggcaga

SEQ ID NO: 4632 - DNA, 15 bp, Homo sapiens
ctgaccaaatggcag

SEQ ID NO: 4633 - DNA, 15 bp, Homo sapiens
tctgaccaaatggca

SEQ ID NO: 4634 - DNA, 15 bp, Homo sapiens
ttctgaccaaatggc

SEQ ID NO: 4635 - DNA, 15 bp, Homo sapiens
cttctgaccaaatgg

SEQ ID NO: 4636 - DNA, 15 bp, Homo sapiens
tcttctgaccaaatg

SEQ ID NO: 4637 - DNA, 15 bp, Homo sapiens
gtcttctgaccaaat

SEQ ID NO: 4638 - DNA, 15 bp, Homo sapiens
cgtcttctgaccaaa

SEQ ID NO: 4639 - DNA, 15 bp, Homo sapiens
ccgtcttctgaccaa

SEQ ID NO: 4640 - DNA, 15 bp, Homo sapiens
accgtcttctgacca

SEQ ID NO: 4641 - DNA, 15 bp, Homo sapiens
aaccgtcttctgacc

SEQ ID NO: 4642 - DNA, 15 bp, Homo sapiens
caaccgtcttctgac

SEQ ID NO: 4643 - DNA, 15 bp, Homo sapiens
gcaaccgtcttctga

SEQ ID NO: 4644 - DNA, 15 bp, Homo sapiens
tgcaaccgtcttctg

SEQ ID NO: 4645 - DNA, 15 bp, Homo sapiens
atgcaaccgtcttct

SEQ ID NO: 4646 - DNA, 15 bp, Homo sapiens
aatgcaaccgtcttc

SEQ ID NO: 4647 - DNA, 15 bp, Homo sapiens
aaatgcaaccgtctt

SEQ ID NO: 4648 - DNA, 15 bp, Homo sapiens
taaatgcaaccgtct

SEQ ID NO: 4649 - DNA, 15 bp, Homo sapiens
gtaaatgcaaccgtc

SEQ ID NO: 4650 - DNA, 15 bp, Homo sapiens
ggtaaatgcaaccgt

SEQ ID NO: 4651 - DNA, 15 bp, Homo sapiens
gggtaaatgcaaccg

SEQ ID NO: 4652 - DNA, 15 bp, Homo sapiens
tgggtaaatgcaacc

SEQ ID NO: 4653 - DNA, 15 bp, Homo sapiens
ctgggtaaatgcaac

SEQ ID NO: 4654 - DNA, 15 bp, Homo sapiens
gctgggtaaatgcaa

SEQ ID NO: 4655 - DNA, 15 bp, Homo sapiens
agctgggtaaatgca

SEQ ID NO: 4656 - DNA, 15 bp, Homo sapiens
tagctgggtaaatgc

SEQ ID NO: 4657 - DNA, 15 bp, Homo sapiens
gtagctgggtaaatg

SEQ ID NO: 4658 - DNA, 15 bp, Homo sapiens
ggtagctgggtaaat

SEQ ID NO: 4659 - DNA, 15 bp, Homo sapiens
tggtagctgggtaaa

SEQ ID NO: 4660 - DNA, 15 bp, Homo sapiens
atggtagctgggtaa

SEQ ID NO: 4661 - DNA, 15 bp, Homo sapiens
aatggtagctgggta

SEQ ID NO: 4662 - DNA, 15 bp, Homo sapiens
caatggtagctgggt

SEQ ID NO: 4663 - DNA, 15 bp, Homo sapiens
gcaatggtagctggg

SEQ ID NO: 4664 - DNA, 15 bp, Homo sapiens
agcaatggtagctgg

SEQ ID NO: 4665 - DNA, 15 bp, Homo sapiens
aagcaatggtagctg

SEQ ID NO: 4666 - DNA, 15 bp, Homo sapiens
gaagcaatggtagct

SEQ ID NO: 4667 - DNA, 15 bp, Homo sapiens
tgaagcaatggtagc

SEQ ID NO: 4668 - DNA, 15 bp, Homo sapiens
ttgaagcaatggtag

SEQ ID NO: 4669 - DNA, 15 bp, Homo sapiens
attgaagcaatggta

SEQ ID NO: 4670 - DNA, 15 bp, Homo sapiens
aattgaagcaatggt

SEQ ID NO: 4671 - DNA, 15 bp, Homo sapiens
caattgaagcaatgg

SEQ ID NO: 4672 - DNA, 15 bp, Homo sapiens
tcaattgaagcaatg

SEQ ID NO: 4673 - DNA, 15 bp, Homo sapiens
atcaattgaagcaat

SEQ ID NO: 4674 - DNA, 15 bp, Homo sapiens
aatcaattgaagcaa

SEQ ID NO: 4675 - DNA, 15 bp, Homo sapiens
aaatcaattgaagca

SEQ ID NO: 4676 - DNA, 15 bp, Homo sapiens
aaaatcaattgaagc

SEQ ID NO: 4677 - DNA, 15 bp, Homo sapiens
taaaatcaattgaag

SEQ ID NO: 4678 - DNA, 15 bp, Homo sapiens
ttaaaatcaattgaa

SEQ ID NO: 4679 - DNA, 15 bp, Homo sapiens
cttaaaatcaattga

SEQ ID NO: 4680 - DNA, 15 bp, Homo sapiens
tcttaaaatcaattg

SEQ ID NO: 4681 - DNA, 15 bp, Homo sapiens
ctcttaaaatcaatt

SEQ ID NO: 4682 - DNA, 15 bp, Homo sapiens
tctcttaaaatcaat

SEQ ID NO: 4683 - DNA, 15 bp, Homo sapiens
ctctcttaaaatcaa

SEQ ID NO: 4684 - DNA, 15 bp, Homo sapiens
tctctcttaaaatca

SEQ ID NO: 4685 - DNA, 15 bp, Homo sapiens
ttctctcttaaaatc

SEQ ID NO: 4686 - DNA, 15 bp, Homo sapiens
tttctctcttaaaat

SEQ ID NO: 4687 - DNA, 15 bp, Homo sapiens
gtttctctcttaaaa

SEQ ID NO: 4688 - DNA, 15 bp, Homo sapiens
ggtttctctcttaaa

SEQ ID NO: 4689 - DNA, 15 bp, Homo sapiens
aggtttctctcttaa

SEQ ID NO: 4690 - DNA, 15 bp, Homo sapiens
caggtttctctctta

SEQ ID NO: 4691 - DNA, 15 bp, Homo sapiens
acaggtttctctctt

SEQ ID NO: 4692 - DNA, 15 bp, Homo sapiens
cacaggtttctctct

SEQ ID NO: 4693 - DNA, 15 bp, Homo sapiens
acacaggtttctctc

SEQ ID NO: 4694 - DNA, 15 bp, Homo sapiens
aacacaggtttctct

SEQ ID NO: 4695 - DNA, 15 bp, Homo sapiens
caacacaggtttctc

SEQ ID NO: 4696 - DNA, 15 bp, Homo sapiens
acaacacaggtttct

SEQ ID NO: 4697 - DNA, 15 bp, Homo sapiens
cacaacacaggtttc

SEQ ID NO: 4698 - DNA, 15 bp, Homo sapiens
ccacaacacaggttt

SEQ ID NO: 4699 - DNA, 15 bp, Homo sapiens
accacaacacaggtt

SEQ ID NO: 4700 - DNA, 15 bp, Homo sapiens
aaccacaacacaggt

SEQ ID NO: 4701 - DNA, 15 bp, Homo sapiens
aaaccacaacacagg

SEQ ID NO: 4702 - DNA, 15 bp, Homo sapiens
taaaccacaacacag

SEQ ID NO: 4703 - DNA, 15 bp, Homo sapiens
gtaaaccacaacaca

SEQ ID NO: 4704 - DNA, 15 bp, Homo sapiens
tgtaaaccacaacac

SEQ ID NO: 4705 - DNA, 15 bp, Homo sapiens
gtgtaaaccacaaca

SEQ ID NO: 4706 - DNA, 15 bp, Homo sapiens
agtgtaaaccacaac

SEQ ID NO: 4707 - DNA, 15 bp, Homo sapiens
cagtgtaaaccacaa

SEQ ID NO: 4708 - DNA, 15 bp, Homo sapiens
ccagtgtaaaccaca

SEQ ID NO: 4709 - DNA, 15 bp, Homo sapiens
tccagtgtaaaccac

SEQ ID NO: 4710 - DNA, 15 bp, Homo sapiens
atccagtgtaaacca

SEQ ID NO: 4711 - DNA, 15 bp, Homo sapiens
tatccagtgtaaacc

SEQ ID NO: 4712 - DNA, 15 bp, Homo sapiens
atatccagtgtaaac

SEQ ID NO: 4713 - DNA, 15 bp, Homo sapiens
catatccagtgtaaa

SEQ ID NO: 4714 - DNA, 15 bp, Homo sapiens
ccatatccagtgtaa

SEQ ID NO: 4715 - DNA, 15 bp, Homo sapiens
tccatatccagtgta

SEQ ID NO: 4716 - DNA, 15 bp, Homo sapiens
ttccatatccagtgt

SEQ ID NO: 4717 - DNA, 15 bp, Homo sapiens
tttccatatccagtg

SEQ ID NO: 4718 - DNA, 15 bp, Homo sapiens
atttccatatccagt

SEQ ID NO: 4719 - DNA, 15 bp, Homo sapiens
tatttccatatccag

SEQ ID NO: 4720 - DNA, 15 bp, Homo sapiens
ctatttccatatcca

SEQ ID NO: 4721 - DNA, 15 bp, Homo sapiens
tctatttccatatcc

SEQ ID NO: 4722 - DNA, 15 bp, Homo sapiens
ctctatttccatatc

SEQ ID NO: 4723 - DNA, 15 bp, Homo sapiens
tctctatttccatat

SEQ ID NO: 4724 - DNA, 15 bp, Homo sapiens
ctctctatttccata

SEQ ID NO: 4725 - DNA, 15 bp, Homo sapiens
cctctctatttccat

SEQ ID NO: 4726 - DNA, 15 bp, Homo sapiens
tcctctctatttcca

SEQ ID NO: 4727 - DNA, 15 bp, Homo sapiens
ctcctctctatttcc

SEQ ID NO: 4728 - DNA, 15 bp, Homo sapiens
gctcctctctatttc

SEQ ID NO: 4729 - DNA, 15 bp, Homo sapiens
tgctcctctctattt

SEQ ID NO: 4730 - DNA, 15 bp, Homo sapiens
ttgctcctctctatt

SEQ ID NO: 4731 - DNA, 15 bp, Homo sapiens
tttgctcctctctat

SEQ ID NO: 4732 - DNA, 15 bp, Homo sapiens
ttttgctcctctcta

SEQ ID NO: 4733 - DNA, 15 bp, Homo sapiens
attttgctcctctct

SEQ ID NO: 4734 - DNA, 15 bp, Homo sapiens
gattttgctcctctc

SEQ ID NO: 4735 - DNA, 15 bp, Homo sapiens
agattttgctcctct

SEQ ID NO: 4736 - DNA, 15 bp, Homo sapiens
cagattttgctcctc

SEQ ID NO: 4737 - DNA, 15 bp, Homo sapiens
acagattttgctcct

SEQ ID NO: 4738 - DNA, 15 bp, Homo sapiens
gacagattttgctcc

SEQ ID NO: 4739 - DNA, 15 bp, Homo sapiens
ggacagattttgctc

SEQ ID NO: 4740 - DNA, 15 bp, Homo sapiens
cggacagattttgct

SEQ ID NO: 4741 - DNA, 15 bp, Homo sapiens
tcggacagattttgc

SEQ ID NO: 4742 - DNA, 15 bp, Homo sapiens
atcggacagattttg

SEQ ID NO: 4743 - DNA, 15 bp, Homo sapiens
gatcggacagatttt

SEQ ID NO: 4744 - DNA, 15 bp, Homo sapiens
agatcggacagattt

SEQ ID NO: 4745 - DNA, 15 bp, Homo sapiens
tagatcggacagatt

SEQ ID NO: 4746 - DNA, 15 bp, Homo sapiens
gtagatcggacagat

SEQ ID NO: 4747 - DNA, 15 bp, Homo sapiens
agtagatcggacaga

SEQ ID NO: 4748 - DNA, 15 bp, Homo sapiens
aagtagatcggacag

SEQ ID NO: 4749 - DNA, 15 bp, Homo sapiens
aaagtagatcggaca

SEQ ID NO: 4750 - DNA, 15 bp, Homo sapiens
gaaagtagatcggac

SEQ ID NO: 4751 - DNA, 15 bp, Homo sapiens
ggaaagtagatcgga

SEQ ID NO: 4752 - DNA, 15 bp, Homo sapiens
gggaaagtagatcgg

SEQ ID NO: 4753 - DNA, 15 bp, Homo sapiens
ggggaaagtagatcg

SEQ ID NO: 4754 - DNA, 15 bp, Homo sapiens
tggggaaagtagatc

SEQ ID NO: 4755 - DNA, 15 bp, Homo sapiens
ttggggaaagtagat

SEQ ID NO: 4756 - DNA, 15 bp, Homo sapiens
attggggaaagtaga

SEQ ID NO: 4757 - DNA, 15 bp, Homo sapiens
gattggggaaagtag

SEQ ID NO: 4758 - DNA, 15 bp, Homo sapiens
agattggggaaagta

SEQ ID NO: 4759 - DNA, 15 bp, Homo sapiens
cagattggggaaagt

SEQ ID NO: 4760 - DNA, 15 bp, Homo sapiens
acagattggggaaag

SEQ ID NO: 4761 - DNA, 15 bp, Homo sapiens
cacagattggggaaa

SEQ ID NO: 4762 - DNA, 15 bp, Homo sapiens
tcacagattggggaa

SEQ ID NO: 4763 - DNA, 15 bp, Homo sapiens
ttcacagattgggga

SEQ ID NO: 4764 - DNA, 15 bp, Homo sapiens
cttcacagattgggg

SEQ ID NO: 4765 - DNA, 15 bp, Homo sapiens
acttcacagattggg

SEQ ID NO: 4766 - DNA, 15 bp, Homo sapiens
tacttcacagattgg

SEQ ID NO: 4767 - DNA, 15 bp, Homo sapiens
ctacttcacagattg

SEQ ID NO: 4768 - DNA, 15 bp, Homo sapiens
gctacttcacagatt

SEQ ID NO: 4769 - DNA, 15 bp, Homo sapiens
agctacttcacagat

SEQ ID NO: 4770 - DNA, 15 bp, Homo sapiens
tagctacttcacaga

SEQ ID NO: 4771 - DNA, 15 bp, Homo sapiens
ttagctacttcacag

SEQ ID NO: 4772 - DNA, 15 bp, Homo sapiens
attagctacttcaca

SEQ ID NO: 4773 - DNA, 15 bp, Homo sapiens
tattagctacttcac

SEQ ID NO: 4774 - DNA, 15 bp, Homo sapiens
ttattagctacttca

SEQ ID NO: 4775 - DNA, 15 bp, Homo sapiens
attattagctacttc

SEQ ID NO: 4776 - DNA, 15 bp, Homo sapiens
tattattagctactt

SEQ ID NO: 4777 - DNA, 15 bp, Homo sapiens
atattattagctact

SEQ ID NO: 4778 - DNA, 15 bp, Homo sapiens
tatattattagctac

SEQ ID NO: 4779 - DNA, 15 bp, Homo sapiens
ctatattattagcta

SEQ ID NO: 4780 - DNA, 15 bp, Homo sapiens
tctatattattagct

SEQ ID NO: 4781 - DNA, 15 bp, Homo sapiens
ttctatattattagc

SEQ ID NO: 4782 - DNA, 15 bp, Homo sapiens
gttctatattattag

SEQ ID NO: 4783 - DNA, 15 bp, Homo sapiens
tgttctatattatta

SEQ ID NO: 4784 - DNA, 15 bp, Homo sapiens
ttgttctatattatt

SEQ ID NO: 4785 - DNA, 15 bp, Homo sapiens
tttgttctatattat

SEQ ID NO: 4786 - DNA, 15 bp, Homo sapiens
ttttgttctatatta

SEQ ID NO: 4787 - DNA, 15 bp, Homo sapiens
attttgttctatatt

SEQ ID NO: 4788 - DNA, 15 bp, Homo sapiens
cattttgttctatat

SEQ ID NO: 4789 - DNA, 15 bp, Homo sapiens
gcattttgttctata

SEQ ID NO: 4790 - DNA, 15 bp, Homo sapiens
agcattttgttctat

SEQ ID NO: 4791 - DNA, 15 bp, Homo sapiens
gagcattttgttcta

SEQ ID NO: 4792 - DNA, 15 bp, Homo sapiens
tgagcattttgttct

SEQ ID NO: 4793 - DNA, 15 bp, Homo sapiens
ttgagcattttgttc

SEQ ID NO: 4794 - DNA, 15 bp, Homo sapiens
cttgagcattttgtt

SEQ ID NO: 4795 - DNA, 15 bp, Homo sapiens
tcttgagcattttgt

SEQ ID NO: 4796 - DNA, 15 bp, Homo sapiens
ctcttgagcattttg

SEQ ID NO: 4797 - DNA, 15 bp, Homo sapiens
cctcttgagcatttt

SEQ ID NO: 4798 - DNA, 15 bp, Homo sapiens
acctcttgagcattt

SEQ ID NO: 4799 - DNA, 15 bp, Homo sapiens
tacctcttgagcatt

SEQ ID NO: 4800 - DNA, 15 bp, Homo sapiens
ttacctcttgagcat

SEQ ID NO: 4801 - DNA, 15 bp, Homo sapiens
cttacctcttgagca

SEQ ID NO: 4802 - DNA, 15 bp, Homo sapiens
ccttacctcttgagc

SEQ ID NO: 4803 - DNA, 15 bp, Homo sapiens
tccttacctcttgag

SEQ ID NO: 4804 - DNA, 15 bp, Homo sapiens
atccttacctcttga

SEQ ID NO: 4805 - DNA, 15 bp, Homo sapiens
tatccttacctcttg

SEQ ID NO: 4806 - DNA, 15 bp, Homo sapiens
gtatccttacctctt

SEQ ID NO: 4807 - DNA, 15 bp, Homo sapiens
tgtatccttacctct

SEQ ID NO: 4808 - DNA, 15 bp, Homo sapiens
ttgtatccttacctc

SEQ ID NO: 4809 - DNA, 15 bp, Homo sapiens
tttgtatccttacct

SEQ ID NO: 4810 - DNA, 15 bp, Homo sapiens
ttttgtatccttacc

SEQ ID NO: 4811 - DNA, 15 bp, Homo sapiens
tttttgtatccttac

SEQ ID NO: 4812 - DNA, 15 bp, Homo sapiens
ttttttgtatcctta

SEQ ID NO: 4813 - DNA, 15 bp, Homo sapiens
tttttttgtatcctt

SEQ ID NO: 4814 - DNA, 15 bp, Homo sapiens
ttttttttgtatcct

SEQ ID NO: 4815 - DNA, 15 bp, Homo sapiens
tttttttttgtatcc

SEQ ID NO: 4816 - DNA, 15 bp, Homo sapiens
ttttttttttgtatc

SEQ ID NO: 4817 - DNA, 15 bp, Homo sapiens
tttttttttttgtat

SEQ ID NO: 4818 - DNA, 15 bp, Homo sapiens
ttttttttttttgta

SEQ ID NO: 4819 - DNA, 15 bp, Homo sapiens
tttttttttttttgt

SEQ ID NO: 4820 - DNA, 15 bp, Homo sapiens
atttttttttttttg

SEQ ID NO: 4821 - DNA, 15 bp, Homo sapiens
aattttttttttttt

SEQ ID NO: 4822 - DNA, 15 bp, Homo sapiens
gaatttttttttttt

SEQ ID NO: 4823 - DNA, 15 bp, Homo sapiens
tgaattttttttttt

SEQ ID NO: 4824 - DNA, 15 bp, Homo sapiens
ttgaatttttttttt

SEQ ID NO: 4825 - DNA, 15 bp, Homo sapiens
attgaattttttttt

SEQ ID NO: 4826 - DNA, 15 bp, Homo sapiens
aattgaatttttttt

SEQ ID NO: 4827 - DNA, 15 bp, Homo sapiens
aaattgaattttttt

SEQ ID NO: 4828 - DNA, 15 bp, Homo sapiens
gaaattgaatttttt

SEQ ID NO: 4829 - DNA, 15 bp, Homo sapiens
agaaattgaattttt

SEQ ID NO: 4830 - DNA, 15 bp, Homo sapiens
cagaaattgaatttt

SEQ ID NO: 4831 - DNA, 15 bp, Homo sapiens
ccagaaattgaattt

SEQ ID NO: 4832 - DNA, 15 bp, Homo sapiens
tccagaaattgaatt

SEQ ID NO: 4833 - DNA, 15 bp, Homo sapiens
ttccagaaattgaat

SEQ ID NO: 4834 - DNA, 15 bp, Homo sapiens
cttccagaaattgaa

SEQ ID NO: 4835 - DNA, 15 bp, Homo sapiens
gcttccagaaattga

SEQ ID NO: 4836 - DNA, 15 bp, Homo sapiens
tgcttccagaaattg

SEQ ID NO: 4837 - DNA, 15 bp, Homo sapiens
ctgcttccagaaatt

SEQ ID NO: 4838 - DNA, 15 bp, Homo sapiens
tctgcttccagaaat

SEQ ID NO: 4839 - DNA, 15 bp, Homo sapiens
ctctgcttccagaaa

SEQ ID NO: 4840 - DNA, 15 bp, Homo sapiens
tctctgcttccagaa

SEQ ID NO: 4841 - DNA, 15 bp, Homo sapiens
gtctctgcttccaga

SEQ ID NO: 4842 - DNA, 15 bp, Homo sapiens
agtctctgcttccag

SEQ ID NO: 4843 - DNA, 15 bp, Homo sapiens
tagtctctgcttcca

SEQ ID NO: 4844 - DNA, 15 bp, Homo sapiens
ctagtctctgcttcc

SEQ ID NO: 4845 - DNA, 15 bp, Homo sapiens
tctagtctctgcttc

SEQ ID NO: 4846 - DNA, 15 bp, Homo sapiens
atctagtctctgctt

SEQ ID NO: 4847 - DNA, 15 bp, Homo sapiens
catctagtctctgct

SEQ ID NO: 4848 - DNA, 15 bp, Homo sapiens
tcatctagtctctgc

SEQ ID NO: 4849 - DNA, 15 bp, Homo sapiens
ctcatctagtctctg

SEQ ID NO: 4850 - DNA, 15 bp, Homo sapiens
tctcatctagtctct

SEQ ID NO: 4851 - DNA, 15 bp, Homo sapiens
ttctcatctagtctc

SEQ ID NO: 4852 - DNA, 15 bp, Homo sapiens
tttctcatctagtct

SEQ ID NO: 4853 - DNA, 15 bp, Homo sapiens
gtttctcatctagtc

SEQ ID NO: 4854 - DNA, 15 bp, Homo sapiens
agtttctcatctagt

SEQ ID NO: 4855 - DNA, 15 bp, Homo sapiens
cagtttctcatctag

SEQ ID NO: 4856 - DNA, 15 bp, Homo sapiens
acagtttctcatcta

SEQ ID NO: 4857 - DNA, 15 bp, Homo sapiens
aacagtttctcatct

SEQ ID NO: 4858 - DNA, 15 bp, Homo sapiens
taacagtttctcatc

SEQ ID NO: 4859 - DNA, 15 bp, Homo sapiens
ttaacagtttctcat

SEQ ID NO: 4860 - DNA, 15 bp, Homo sapiens
tttaacagtttctca

SEQ ID NO: 4861 - DNA, 15 bp, Homo sapiens
gtttaacagtttctc

SEQ ID NO: 4862 - DNA, 15 bp, Homo sapiens
tgtttaacagtttct

SEQ ID NO: 4863 - DNA, 15 bp, Homo sapiens
ctgtttaacagtttc

SEQ ID NO: 4864 - DNA, 15 bp, Homo sapiens
actgtttaacagttt

SEQ ID NO: 4865 - DNA, 15 bp, Homo sapiens
tactgtttaacagtt

SEQ ID NO: 4866 - DNA, 15 bp, Homo sapiens
atactgtttaacagt

SEQ ID NO: 4867 - DNA, 15 bp, Homo sapiens
tatactgtttaacag

SEQ ID NO: 4868 - DNA, 15 bp, Homo sapiens
gtatactgtttaaca

SEQ ID NO: 4869 - DNA, 15 bp, Homo sapiens
tgtatactgtttaac

SEQ ID NO: 4870 - DNA, 15 bp, Homo sapiens
gtgtatactgtttaa

SEQ ID NO: 4871 - DNA, 15 bp, Homo sapiens
tgtgtatactgttta

SEQ ID NO: 4872 - DNA, 15 bp, Homo sapiens
ctgtgtatactgttt

SEQ ID NO: 4873 - DNA, 15 bp, Homo sapiens
actgtgtatactgtt

SEQ ID NO: 4874 - DNA, 15 bp, Homo sapiens
aactgtgtatactgt

SEQ ID NO: 4875 - DNA, 15 bp, Homo sapiens
caactgtgtatactg

SEQ ID NO: 4876 - DNA, 15 bp, Homo sapiens
acaactgtgtatact

SEQ ID NO: 4877 - DNA, 15 bp, Homo sapiens
gacaactgtgtatac

SEQ ID NO: 4878 - DNA, 15 bp, Homo sapiens
tgacaactgtgtata

SEQ ID NO: 4879 - DNA, 15 bp, Homo sapiens
ctgacaactgtgtat

SEQ ID NO: 4880 - DNA, 15 bp, Homo sapiens
actgacaactgtgta

SEQ ID NO: 4881 - DNA, 15 bp, Homo sapiens
aactgacaactgtgt

SEQ ID NO: 4882 - DNA, 15 bp, Homo sapiens
aaactgacaactgtg

SEQ ID NO: 4883 - DNA, 15 bp, Homo sapiens
caaactgacaactgt

SEQ ID NO: 4884 - DNA, 15 bp, Homo sapiens
tcaaactgacaactg

SEQ ID NO: 4885 - DNA, 15 bp, Homo sapiens
atcaaactgacaact

SEQ ID NO: 4886 - DNA, 15 bp, Homo sapiens
gatcaaactgacaac

SEQ ID NO: 4887 - DNA, 15 bp, Homo sapiens
ggatcaaactgacaa

SEQ ID NO: 4888 - DNA, 15 bp, Homo sapiens
tggatcaaactgaca

SEQ ID NO: 4889 - DNA, 15 bp, Homo sapiens
gtggatcaaactgac

SEQ ID NO: 4890 - DNA, 15 bp, Homo sapiens
ggtggatcaaactga

SEQ ID NO: 4891 - DNA, 15 bp, Homo sapiens
cggtggatcaaactg

SEQ ID NO: 4892 - DNA, 15 bp, Homo sapiens
tcggtggatcaaact

SEQ ID NO: 4893 - DNA, 15 bp, Homo sapiens
ctcggtggatcaaac

SEQ ID NO: 4894 - DNA, 15 bp, Homo sapiens
cctcggtggatcaaa

SEQ ID NO: 4895 - DNA, 15 bp, Homo sapiens
gcctcggtggatcaa

SEQ ID NO: 4896 - DNA, 15 bp, Homo sapiens
tgcctcggtggatca

SEQ ID NO: 4897 - DNA, 15 bp, Homo sapiens
atgcctcggtggatc

SEQ ID NO: 4898 - DNA, 15 bp, Homo sapiens
aatgcctcggtggat

SEQ ID NO: 4899 - DNA, 15 bp, Homo sapiens
taatgcctcggtgga

SEQ ID NO: 4900 - DNA, 15 bp, Homo sapiens
ttaatgcctcggtgg

SEQ ID NO: 4901 - DNA, 15 bp, Homo sapiens
attaatgcctcggtg

SEQ ID NO: 4902 - DNA, 15 bp, Homo sapiens
aattaatgcctcggt

SEQ ID NO: 4903 - DNA, 15 bp, Homo sapiens
aaattaatgcctcgg

SEQ ID NO: 4904 - DNA, 15 bp, Homo sapiens
aaaattaatgcctcg

SEQ ID NO: 4905 - DNA, 15 bp, Homo sapiens
aaaaattaatgcctc

SEQ ID NO: 4906 - DNA, 15 bp, Homo sapiens
aaaaaattaatgcct

SEQ ID NO: 4907 - DNA, 15 bp, Homo sapiens
gaaaaaattaatgcc

SEQ ID NO: 4908 - DNA, 15 bp, Homo sapiens
agaaaaaattaatgc

SEQ ID NO: 4909 - DNA, 15 bp, Homo sapiens
aagaaaaaattaatg

SEQ ID NO: 4910 - DNA, 15 bp, Homo sapiens
taagaaaaaattaat

SEQ ID NO: 4911 - DNA, 15 bp, Homo sapiens
ttaagaaaaaattaa

SEQ ID NO: 4912 - DNA, 15 bp, Homo sapiens
attaagaaaaaatta

SEQ ID NO: 4913 - DNA, 15 bp, Homo sapiens
gattaagaaaaaatt

SEQ ID NO: 4914 - DNA, 15 bp, Homo sapiens
tgattaagaaaaaat

SEQ ID NO: 4915 - DNA, 15 bp, Homo sapiens
gtgattaagaaaaaa

SEQ ID NO: 4916 - DNA, 15 bp, Homo sapiens
tgtgattaagaaaaa

SEQ ID NO: 4917 - DNA, 15 bp, Homo sapiens
gtgtgattaagaaaa

SEQ ID NO: 4918 - DNA, 15 bp, Homo sapiens
ggtgtgattaagaaa

SEQ ID NO: 4919 - DNA, 15 bp, Homo sapiens
gggtgtgattaagaa

SEQ ID NO: 4920 - DNA, 15 bp, Homo sapiens
agggtgtgattaaga

SEQ ID NO: 4921 - DNA, 15 bp, Homo sapiens
aagggtgtgattaag

SEQ ID NO: 4922 - DNA, 15 bp, Homo sapiens
taagggtgtgattaa

SEQ ID NO: 4923 - DNA, 15 bp, Homo sapiens
ataagggtgtgatta

SEQ ID NO: 4924 - DNA, 15 bp, Homo sapiens
tataagggtgtgatt

SEQ ID NO: 4925 - DNA, 15 bp, Homo sapiens
ttataagggtgtgat

SEQ ID NO: 4926 - DNA, 15 bp, Homo sapiens
gttataagggtgtga

SEQ ID NO: 4927 - DNA, 15 bp, Homo sapiens
tgttataagggtgtg

SEQ ID NO: 4928 - DNA, 15 bp, Homo sapiens
ttgttataagggtgt

SEQ ID NO: 4929 - DNA, 15 bp, Homo sapiens
tttgttataagggtg

SEQ ID NO: 4930 - DNA, 15 bp, Homo sapiens
ttttgttataagggt

SEQ ID NO: 4931 - DNA, 15 bp, Homo sapiens
tttttgttataaggg

SEQ ID NO: 4932 - DNA, 15 bp, Homo sapiens
gtttttgttataagg

SEQ ID NO: 4933 - DNA, 15 bp, Homo sapiens
ggtttttgttataag

SEQ ID NO: 4934 - DNA, 15 bp, Homo sapiens
aggtttttgttataa

SEQ ID NO: 4935 - DNA, 15 bp, Homo sapiens
caggtttttgttata

SEQ ID NO: 4936 - DNA, 15 bp, Homo sapiens
gcaggtttttgttat

SEQ ID NO: 4937 - DNA, 15 bp, Homo sapiens
tgcaggtttttgtta

SEQ ID NO: 4938 - DNA, 15 bp, Homo sapiens
atgcaggtttttgtt

SEQ ID NO: 4939 - DNA, 15 bp, Homo sapiens
tatgcaggtttttgt

SEQ ID NO: 4940 - DNA, 15 bp, Homo sapiens
atatgcaggtttttg

SEQ ID NO: 4941 - DNA, 15 bp, Homo sapiens
aatatgcaggttttt

SEQ ID NO: 4942 - DNA, 15 bp, Homo sapiens
aaatatgcaggtttt

SEQ ID NO: 4943 - DNA, 15 bp, Homo sapiens
aaaatatgcaggttt

SEQ ID NO: 4944 - DNA, 15 bp, Homo sapiens
aaaaatatgcaggtt

SEQ ID NO: 4945 - DNA, 15 bp, Homo sapiens
aaaaaatatgcaggt

SEQ ID NO: 4946 - DNA, 15 bp, Homo sapiens
gaaaaaatatgcagg

SEQ ID NO: 4947 - DNA, 15 bp, Homo sapiens
agaaaaaatatgcag

SEQ ID NO: 4948 - DNA, 15 bp, Homo sapiens
aagaaaaaatatgca

SEQ ID NO: 4949 - DNA, 15 bp, Homo sapiens
aaagaaaaaatatgc

SEQ ID NO: 4950 - DNA, 15 bp, Homo sapiens
aaaagaaaaaatatg

SEQ ID NO: 4951 - DNA, 15 bp, Homo sapiens
aaaaagaaaaaatat

SEQ ID NO: 4952 - DNA, 15 bp, Homo sapiens
taaaaagaaaaaata

SEQ ID NO: 4953 - DNA, 15 bp, Homo sapiens
ttaaaaagaaaaaat

SEQ ID NO: 4954 - DNA, 15 bp, Homo sapiens
tttaaaaagaaaaaa

SEQ ID NO: 4955 - DNA, 15 bp, Homo sapiens
ctttaaaaagaaaaa

SEQ ID NO: 4956 - DNA, 15 bp, Homo sapiens
tctttaaaaagaaaa

SEQ ID NO: 4957 - DNA, 15 bp, Homo sapiens
ttctttaaaaagaaa

SEQ ID NO: 4958 - DNA, 15 bp, Homo sapiens
attctttaaaaagaa

SEQ ID NO: 4959 - DNA, 15 bp, Homo sapiens
cattctttaaaaaga

SEQ ID NO: 4960 - DNA, 15 bp, Homo sapiens
tcattctttaaaaag

SEQ ID NO: 4961 - DNA, 15 bp, Homo sapiens
ttcattctttaaaaa

SEQ ID NO: 4962 - DNA, 15 bp, Homo sapiens
tttcattctttaaaa

SEQ ID NO: 4963 - DNA, 15 bp, Homo sapiens
ttttcattctttaaa

SEQ ID NO: 4964 - DNA, 15 bp, Homo sapiens
attttcattctttaa

SEQ ID NO: 4965 - DNA, 15 bp, Homo sapiens
cattttcattcttta

SEQ ID NO: 4966 - DNA, 15 bp, Homo sapiens
tcattttcattcttt

SEQ ID NO: 4967 - DNA, 15 bp, Homo sapiens
ttcattttcattctt

SEQ ID NO: 4968 - DNA, 15 bp, Homo sapiens
tttcattttcattct

SEQ ID NO: 4969 - DNA, 15 bp, Homo sapiens
ctttcattttcattc

SEQ ID NO: 4970 - DNA, 15 bp, Homo sapiens
gctttcattttcatt

SEQ ID NO: 4971 - DNA, 15 bp, Homo sapiens
ggctttcattttcat

SEQ ID NO: 4972 - DNA, 15 bp, Homo sapiens
tggctttcattttca

SEQ ID NO: 4973 - DNA, 15 bp, Homo sapiens
ttggctttcattttc

SEQ ID NO: 4974 - DNA, 15 bp, Homo sapiens
cttggctttcatttt

SEQ ID NO: 4975 - DNA, 15 bp, Homo sapiens
acttggctttcattt

SEQ ID NO: 4976 - DNA, 15 bp, Homo sapiens
aacttggctttcatt

SEQ ID NO: 4977 - DNA, 15 bp, Homo sapiens
aaacttggctttcat

SEQ ID NO: 4978 - DNA, 15 bp, Homo sapiens
gaaacttggctttca

SEQ ID NO: 4979 - DNA, 15 bp, Homo sapiens
tgaaacttggctttc

SEQ ID NO: 4980 - DNA, 15 bp, Homo sapiens
ttgaaacttggcttt

SEQ ID NO: 4981 - DNA, 15 bp, Homo sapiens
gttgaaacttggctt

SEQ ID NO: 4982 - DNA, 15 bp, Homo sapiens
tgttgaaacttggct

SEQ ID NO: 4983 - DNA, 15 bp, Homo sapiens
ctgttgaaacttggc

SEQ ID NO: 4984 - DNA, 15 bp, Homo sapiens
tctgttgaaacttgg

SEQ ID NO: 4985 - DNA, 15 bp, Homo sapiens
atctgttgaaacttg

SEQ ID NO: 4986 - DNA, 15 bp, Homo sapiens
catctgttgaaactt

SEQ ID NO: 4987 - DNA, 15 bp, Homo sapiens
tcatctgttgaaact

SEQ ID NO: 4988 - DNA, 15 bp, Homo sapiens
ttcatctgttgaaac

SEQ ID NO: 4989 - DNA, 15 bp, Homo sapiens
tttcatctgttgaaa

SEQ ID NO: 4990 - DNA, 15 bp, Homo sapiens
ctttcatctgttgaa

SEQ ID NO: 4991 - DNA, 15 bp, Homo sapiens
actttcatctgttga

SEQ ID NO: 4992 - DNA, 15 bp, Homo sapiens
cactttcatctgttg

SEQ ID NO: 4993 - DNA, 15 bp, Homo sapiens
tcactttcatctgtt

SEQ ID NO: 4994 - DNA, 15 bp, Homo sapiens
ctcactttcatctgt

SEQ ID NO: 4995 - DNA, 15 bp, Homo sapiens
tctcactttcatctg

SEQ ID NO: 4996 - DNA, 15 bp, Homo sapiens
ttctcactttcatct

SEQ ID NO: 4997 - DNA, 15 bp, Homo sapiens
gttctcactttcatc

SEQ ID NO: 4998 - DNA, 15 bp, Homo sapiens
agttctcactttcat

SEQ ID NO: 4999 - DNA, 15 bp, Homo sapiens
gagttctcactttca

SEQ ID NO: 5000 - DNA, 15 bp, Homo sapiens
ggagttctcactttc

SEQ ID NO: 5001 - DNA, 15 bp, Homo sapiens
tggagttctcacttt

SEQ ID NO: 5002 - DNA, 15 bp, Homo sapiens
ctggagttctcactt

SEQ ID NO: 5003 - DNA, 15 bp, Homo sapiens
cctggagttctcact

SEQ ID NO: 5004 - DNA, 15 bp, Homo sapiens
acctggagttctcac

SEQ ID NO: 5005 - DNA, 15 bp, Homo sapiens
gacctggagttctca

SEQ ID NO: 5006 - DNA, 15 bp, Homo sapiens
agacctggagttctc

SEQ ID NO: 5007 - DNA, 15 bp, Homo sapiens
gagacctggagttct

SEQ ID NO: 5008 - DNA, 15 bp, Homo sapiens
ggagacctggagttc

SEQ ID NO: 5009 - DNA, 15 bp, Homo sapiens
aggagacctggagtt

SEQ ID NO: 5010 - DNA, 15 bp, Homo sapiens
caggagacctggagt

SEQ ID NO: 5011 - DNA, 15 bp, Homo sapiens
ccaggagacctggag

SEQ ID NO: 5012 - DNA, 15 bp, Homo sapiens
tccaggagacctgga

SEQ ID NO: 5013 - DNA, 15 bp, Homo sapiens
ttccaggagacctgg

SEQ ID NO: 5014 - DNA, 15 bp, Homo sapiens
tttccaggagacctg

SEQ ID NO: 5015 - DNA, 15 bp, Homo sapiens
atttccaggagacct

SEQ ID NO: 5016 - DNA, 15 bp, Homo sapiens
tatttccaggagacc

SEQ ID NO: 5017 - DNA, 15 bp, Homo sapiens
ttatttccaggagac

SEQ ID NO: 5018 - DNA, 15 bp, Homo sapiens
tttatttccaggaga

SEQ ID NO: 5019 - DNA, 15 bp, Homo sapiens
atttatttccaggag

SEQ ID NO: 5020 - DNA, 15 bp, Homo sapiens
gatttatttccagga

SEQ ID NO: 5021 - DNA, 15 bp, Homo sapiens
tgatttatttccagg

SEQ ID NO: 5022 - DNA, 15 bp, Homo sapiens
ctgatttatttccag

SEQ ID NO: 5023 - DNA, 15 bp, Homo sapiens
tctgatttatttcca

SEQ ID NO: 5024 - DNA, 15 bp, Homo sapiens
atctgatttatttcc

SEQ ID NO: 5025 - DNA, 15 bp, Homo sapiens
tatctgatttatttc

SEQ ID NO: 5026 - DNA, 15 bp, Homo sapiens
ttatctgatttattt

SEQ ID NO: 5027 - DNA, 15 bp, Homo sapiens
gttatctgatttatt

SEQ ID NO: 5028 - DNA, 15 bp, Homo sapiens
tgttatctgatttat

SEQ ID NO: 5029 - DNA, 15 bp, Homo sapiens
atgttatctgattta

SEQ ID NO: 5030 - DNA, 15 bp, Homo sapiens
gatgttatctgattt

SEQ ID NO: 5031 - DNA, 15 bp, Homo sapiens
tgatgttatctgatt

SEQ ID NO: 5032 - DNA, 15 bp, Homo sapiens
ttgatgttatctgat

SEQ ID NO: 5033 - DNA, 15 bp, Homo sapiens
cttgatgttatctga

SEQ ID NO: 5034 - DNA, 15 bp, Homo sapiens
gcttgatgttatctg

SEQ ID NO: 5035 - DNA, 15 bp, Homo sapiens
ggcttgatgttatct

SEQ ID NO: 5036 - DNA, 15 bp, Homo sapiens
gggcttgatgttatc

SEQ ID NO: 5037 - DNA, 15 bp, Homo sapiens
tgggcttgatgttat

SEQ ID NO: 5038 - DNA, 15 bp, Homo sapiens
ttgggcttgatgtta

SEQ ID NO: 5039 - DNA, 15 bp, Homo sapiens
tttgggcttgatgtt

SEQ ID NO: 5040 - DNA, 15 bp, Homo sapiens
atttgggcttgatgt

SEQ ID NO: 5041 - DNA, 15 bp, Homo sapiens
gatttgggcttgatg

SEQ ID NO: 5042 - DNA, 15 bp, Homo sapiens
agatttgggcttgat

SEQ ID NO: 5043 - DNA, 15 bp, Homo sapiens
cagatttgggcttga

SEQ ID NO: 5044 - DNA, 15 bp, Homo sapiens
gcagatttgggcttg

SEQ ID NO: 5045 - DNA, 15 bp, Homo sapiens
agcagatttgggctt

SEQ ID NO: 5046 - DNA, 15 bp, Homo sapiens
gagcagatttgggct

SEQ ID NO: 5047 - DNA, 15 bp, Homo sapiens
ggagcagatttgggc

SEQ ID NO: 5048 - DNA, 15 bp, Homo sapiens
tggagcagatttggg

SEQ ID NO: 5049 - DNA, 15 bp, Homo sapiens
atggagcagatttgg

SEQ ID NO: 5050 - DNA, 15 bp, Homo sapiens
catggagcagatttg

SEQ ID NO: 5051 - DNA, 15 bp, Homo sapiens
ccatggagcagattt

SEQ ID NO: 5052 - DNA, 15 bp, Homo sapiens
tccatggagcagatt

SEQ ID NO: 5053 - DNA, 15 bp, Homo sapiens
ttccatggagcagat

SEQ ID NO: 5054 - DNA, 15 bp, Homo sapiens
gttccatggagcaga

SEQ ID NO: 5055 - DNA, 15 bp, Homo sapiens
agttccatggagcag

SEQ ID NO: 5056 - DNA, 15 bp, Homo sapiens
gagttccatggagca

SEQ ID NO: 5057 - DNA, 15 bp, Homo sapiens
agagttccatggagc

SEQ ID NO: 5058 - DNA, 15 bp, Homo sapiens
aagagttccatggag

SEQ ID NO: 5059 - DNA, 15 bp, Homo sapiens
aaagagttccatgga

SEQ ID NO: 5060 - DNA, 15 bp, Homo sapiens
aaaagagttccatgg

SEQ ID NO: 5061 - DNA, 15 bp, Homo sapiens
gaaaagagttccatg

SEQ ID NO: 5062 - DNA, 15 bp, Homo sapiens
agaaaagagttccat

SEQ ID NO: 5063 - DNA, 15 bp, Homo sapiens
gagaaaagagttcca

SEQ ID NO: 5064 - DNA, 15 bp, Homo sapiens
ggagaaaagagttcc

SEQ ID NO: 5065 - DNA, 15 bp, Homo sapiens
gggagaaaagagttc

SEQ ID NO: 5066 - DNA, 15 bp, Homo sapiens
agggagaaaagagtt

SEQ ID NO: 5067 - DNA, 15 bp, Homo sapiens
gagggagaaaagagt

SEQ ID NO: 5068 - DNA, 15 bp, Homo sapiens
ggagggagaaaagag

SEQ ID NO: 5069 - DNA, 15 bp, Homo sapiens
tggagggagaaaaga

SEQ ID NO: 5070 - DNA, 15 bp, Homo sapiens
gtggagggagaaaag

SEQ ID NO: 5071 - DNA, 15 bp, Homo sapiens
ggtggagggagaaaa

SEQ ID NO: 5072 - DNA, 15 bp, Homo sapiens
tggtggagggagaaa

SEQ ID NO: 5073 - DNA, 15 bp, Homo sapiens
gtggtggagggagaa

SEQ ID NO: 5074 - DNA, 15 bp, Homo sapiens
ggtggtggagggaga

SEQ ID NO: 5075 - DNA, 15 bp, Homo sapiens
gggtggtggagggag

SEQ ID NO: 5076 - DNA, 15 bp, Homo sapiens
ggggtggtggaggga

SEQ ID NO: 5077 - DNA, 15 bp, Homo sapiens
gggggtggtggaggg

SEQ ID NO: 5078 - DNA, 15 bp, Homo sapiens
ggggggtggtggagg

SEQ ID NO: 5079 - DNA, 15 bp, Homo sapiens
tggggggtggtggag

SEQ ID NO: 5080 - DNA, 15 bp, Homo sapiens
atggggggtggtgga

SEQ ID NO: 5081 - DNA, 15 bp, Homo sapiens
catggggggtggtgg

SEQ ID NO: 5082 - DNA, 15 bp, Homo sapiens
gcatggggggtggtg

SEQ ID NO: 5083 - DNA, 15 bp, Homo sapiens
ggcatggggggtggt

SEQ ID NO: 5084 - DNA, 15 bp, Homo sapiens
tggcatggggggtgg

SEQ ID NO: 5085 - DNA, 15 bp, Homo sapiens
ctggcatggggggtg

SEQ ID NO: 5086 - DNA, 15 bp, Homo sapiens
cctggcatggggggt

SEQ ID NO: 5087 - DNA, 15 bp, Homo sapiens
ccctggcatgggggg

SEQ ID NO: 5088 - DNA, 15 bp, Homo sapiens
gccctggcatggggg

SEQ ID NO: 5089 - DNA, 15 bp, Homo sapiens
ggccctggcatgggg

SEQ ID NO: 5090 - DNA, 15 bp, Homo sapiens
tggccctggcatggg

SEQ ID NO: 5091 - DNA, 15 bp, Homo sapiens
ttggccctggcatgg

SEQ ID NO: 5092 - DNA, 15 bp, Homo sapiens
cttggccctggcatg

SEQ ID NO: 5093 - DNA, 15 bp, Homo sapiens
tcttggccctggcat

SEQ ID NO: 5094 - DNA, 15 bp, Homo sapiens
gtcttggccctggca

SEQ ID NO: 5095 - DNA, 15 bp, Homo sapiens
agtcttggccctggc

SEQ ID NO: 5096 - DNA, 15 bp, Homo sapiens
cagtcttggccctgg

SEQ ID NO: 5097 - DNA, 15 bp, Homo sapiens
ccagtcttggccctg

SEQ ID NO: 5098 - DNA, 15 bp, Homo sapiens
cccagtcttggccct

SEQ ID NO: 5099 - DNA, 15 bp, Homo sapiens
tcccagtcttggccc

SEQ ID NO: 5100 - DNA, 15 bp, Homo sapiens
gtcccagtcttggcc

SEQ ID NO: 5101 - DNA, 15 bp, Homo sapiens
ggtcccagtcttggc

SEQ ID NO: 5102 - DNA, 15 bp, Homo sapiens
tggtcccagtcttgg

SEQ ID NO: 5103 - DNA, 15 bp, Homo sapiens
ctggtcccagtcttg

SEQ ID NO: 5104 - DNA, 15 bp, Homo sapiens
cctggtcccagtctt

SEQ ID NO: 5105 - DNA, 15 bp, Homo sapiens
tcctggtcccagtct

SEQ ID NO: 5106 - DNA, 15 bp, Homo sapiens
ttcctggtcccagtc

SEQ ID NO: 5107 - DNA, 15 bp, Homo sapiens
tttcctggtcccagt

SEQ ID NO: 5108 - DNA, 15 bp, Homo sapiens
ctttcctggtcccag

SEQ ID NO: 5109 - DNA, 15 bp, Homo sapiens
cctttcctggtccca

SEQ ID NO: 5110 - DNA, 15 bp, Homo sapiens
acctttcctggtccc

SEQ ID NO: 5111 - DNA, 15 bp, Homo sapiens
tacctttcctggtcc

SEQ ID NO: 5112 - DNA, 15 bp, Homo sapiens
ttacctttcctggtc

SEQ ID NO: 5113 - DNA, 15 bp, Homo sapiens
tttacctttcctggt

SEQ ID NO: 5114 - DNA, 15 bp, Homo sapiens
gtttacctttcctgg

SEQ ID NO: 5115 - DNA, 15 bp, Homo sapiens
ggtttacctttcctg

SEQ ID NO: 5116 - DNA, 15 bp, Homo sapiens
aggtttacctttcct

SEQ ID NO: 5117 - DNA, 15 bp, Homo sapiens
aaggtttacctttcc

SEQ ID NO: 5118 - DNA, 15 bp, Homo sapiens
gaaggtttacctttc

SEQ ID NO: 5119 - DNA, 15 bp, Homo sapiens
agaaggtttaccttt

SEQ ID NO: 5120 - DNA, 15 bp, Homo sapiens
tagaaggtttacctt

SEQ ID NO: 5121 - DNA, 15 bp, Homo sapiens
atagaaggtttacct

SEQ ID NO: 5122 - DNA, 15 bp, Homo sapiens
catagaaggtttacc

SEQ ID NO: 5123 - DNA, 15 bp, Homo sapiens
tcatagaaggtttac

SEQ ID NO: 5124 - DNA, 15 bp, Homo sapiens
ttcatagaaggttta

SEQ ID NO: 5125 - DNA, 15 bp, Homo sapiens
tttcatagaaggttt

SEQ ID NO: 5126 - DNA, 15 bp, Homo sapiens
ctttcatagaaggtt

SEQ ID NO: 5127 - DNA, 15 bp, Homo sapiens
actttcatagaaggt

SEQ ID NO: 5128 - DNA, 15 bp, Homo sapiens
aactttcatagaagg

SEQ ID NO: 5129 - DNA, 15 bp, Homo sapiens
aaactttcatagaag

SEQ ID NO: 5130 - DNA, 15 bp, Homo sapiens
aaaactttcatagaa

SEQ ID NO: 5131 - DNA, 15 bp, Homo sapiens
gaaaactttcataga

SEQ ID NO: 5132 - DNA, 15 bp, Homo sapiens
ggaaaactttcatag

SEQ ID NO: 5133 - DNA, 15 bp, Homo sapiens
tggaaaactttcata

SEQ ID NO: 5134 - DNA, 15 bp, Homo sapiens
ctggaaaactttcat

SEQ ID NO: 5135 - DNA, 15 bp, Homo sapiens
tctggaaaactttca

SEQ ID NO: 5136 - DNA, 15 bp, Homo sapiens
ttctggaaaactttc

SEQ ID NO: 5137 - DNA, 15 bp, Homo sapiens
tttctggaaaacttt

SEQ ID NO: 5138 - DNA, 15 bp, Homo sapiens
ttttctggaaaactt

SEQ ID NO: 5139 - DNA, 15 bp, Homo sapiens
attttctggaaaact

SEQ ID NO: 5140 - DNA, 15 bp, Homo sapiens
tattttctggaaaac

SEQ ID NO: 5141 - DNA, 15 bp, Homo sapiens
ctattttctggaaaa

SEQ ID NO: 5142 - DNA, 15 bp, Homo sapiens
actattttctggaaa

SEQ ID NO: 5143 - DNA, 15 bp, Homo sapiens
aactattttctggaa

SEQ ID NO: 5144 - DNA, 15 bp, Homo sapiens
taactattttctgga

SEQ ID NO: 5145 - DNA, 15 bp, Homo sapiens
ttaactattttctgg

SEQ ID NO: 5146 - DNA, 15 bp, Homo sapiens
attaactattttctg

SEQ ID NO: 5147 - DNA, 15 bp, Homo sapiens
cattaactattttct

SEQ ID NO: 5148 - DNA, 15 bp, Homo sapiens
acattaactattttc

SEQ ID NO: 5149 - DNA, 15 bp, Homo sapiens
gacattaactatttt

SEQ ID NO: 5150 - DNA, 15 bp, Homo sapiens
cgacattaactattt

SEQ ID NO: 5151 - DNA, 15 bp, Homo sapiens
ccgacattaactatt

SEQ ID NO: 5152 - DNA, 15 bp, Homo sapiens
cccgacattaactat

SEQ ID NO: 5153 - DNA, 15 bp, Homo sapiens
tcccgacattaacta

SEQ ID NO: 5154 - DNA, 15 bp, Homo sapiens
gtcccgacattaact

SEQ ID NO: 5155 - DNA, 15 bp, Homo sapiens
tgtcccgacattaac

SEQ ID NO: 5156 - DNA, 15 bp, Homo sapiens
atgtcccgacattaa

SEQ ID NO: 5157 - DNA, 15 bp, Homo sapiens
aatgtcccgacatta

SEQ ID NO: 5158 - DNA, 15 bp, Homo sapiens
aaatgtcccgacatt

SEQ ID NO: 5159 - DNA, 15 bp, Homo sapiens
taaatgtcccgacat

SEQ ID NO: 5160 - DNA, 15 bp, Homo sapiens
ttaaatgtcccgaca

SEQ ID NO: 5161 - DNA, 15 bp, Homo sapiens
gttaaatgtcccgac

SEQ ID NO: 5162 - DNA, 15 bp, Homo sapiens
ggttaaatgtcccga

SEQ ID NO: 5163 - DNA, 15 bp, Homo sapiens
aggttaaatgtcccg

SEQ ID NO: 5164 - DNA, 15 bp, Homo sapiens
gaggttaaatgtccc

SEQ ID NO: 5165 - DNA, 15 bp, Homo sapiens
agaggttaaatgtcc

SEQ ID NO: 5166 - DNA, 15 bp, Homo sapiens
gagaggttaaatgtc

SEQ ID NO: 5167 - DNA, 15 bp, Homo sapiens
agagaggttaaatgt

SEQ ID NO: 5168 - DNA, 15 bp, Homo sapiens
cagagaggttaaatg

SEQ ID NO: 5169 - DNA, 15 bp, Homo sapiens
acagagaggttaaat

SEQ ID NO: 5170 - DNA, 15 bp, Homo sapiens
aacagagaggttaaa

SEQ ID NO: 5171 - DNA, 15 bp, Homo sapiens
taacagagaggttaa

SEQ ID NO: 5172 - DNA, 15 bp, Homo sapiens
ttaacagagaggtta

SEQ ID NO: 5173 - DNA, 15 bp, Homo sapiens
gttaacagagaggtt

SEQ ID NO: 5174 - DNA, 15 bp, Homo sapiens
agttaacagagaggt

SEQ ID NO: 5175 - DNA, 15 bp, Homo sapiens
tagttaacagagagg

SEQ ID NO: 5176 - DNA, 15 bp, Homo sapiens
ttagttaacagagag

SEQ ID NO: 5177 - DNA, 15 bp, Homo sapiens
attagttaacagaga

SEQ ID NO: 5178 - DNA, 15 bp, Homo sapiens
aattagttaacagag

SEQ ID NO: 5179 - DNA, 15 bp, Homo sapiens
aaattagttaacaga

SEQ ID NO: 5180 - DNA, 15 bp, Homo sapiens
caaattagttaacag

SEQ ID NO: 5181 - DNA, 15 bp, Homo sapiens
acaaattagttaaca

SEQ ID NO: 5182 - DNA, 15 bp, Homo sapiens
tacaaattagttaac

SEQ ID NO: 5183 - DNA, 15 bp, Homo sapiens
ctacaaattagttaa

SEQ ID NO: 5184 - DNA, 15 bp, Homo sapiens
gctacaaattagtta

SEQ ID NO: 5185 - DNA, 15 bp, Homo sapiens
agctacaaattagtt

SEQ ID NO: 5186 - DNA, 15 bp, Homo sapiens
gagctacaaattagt

SEQ ID NO: 5187 - DNA, 15 bp, Homo sapiens
agagctacaaattag

SEQ ID NO: 5188 - DNA, 15 bp, Homo sapiens
gagagctacaaatta

SEQ ID NO: 5189 - DNA, 15 bp, Homo sapiens
ggagagctacaaatt

SEQ ID NO: 5190 - DNA, 15 bp, Homo sapiens
gggagagctacaaat

SEQ ID NO: 5191 - DNA, 15 bp, Homo sapiens
tgggagagctacaaa

SEQ ID NO: 5192 - DNA, 15 bp, Homo sapiens
atgggagagctacaa

SEQ ID NO: 5193 - DNA, 15 bp, Homo sapiens
catgggagagctaca

SEQ ID NO: 5194 - DNA, 15 bp, Homo sapiens
tcatgggagagctac

SEQ ID NO: 5195 - DNA, 15 bp, Homo sapiens
ttcatgggagagcta

SEQ ID NO: 5196 - DNA, 15 bp, Homo sapiens
tttcatgggagagct

SEQ ID NO: 5197 - DNA, 15 bp, Homo sapiens
gtttcatgggagagc

SEQ ID NO: 5198 - DNA, 15 bp, Homo sapiens
agtttcatgggagag

SEQ ID NO: 5199 - DNA, 15 bp, Homo sapiens
aagtttcatgggaga

SEQ ID NO: 5200 - DNA, 15 bp, Homo sapiens
aaagtttcatgggag

SEQ ID NO: 5201 - DNA, 15 bp, Homo sapiens
aaaagtttcatggga

SEQ ID NO: 5202 - DNA, 15 bp, Homo sapiens
caaaagtttcatggg

SEQ ID NO: 5203 - DNA, 15 bp, Homo sapiens
acaaaagtttcatgg

SEQ ID NO: 5204 - DNA, 15 bp, Homo sapiens
tacaaaagtttcatg

SEQ ID NO: 5205 - DNA, 15 bp, Homo sapiens
ctacaaaagtttcat

SEQ ID NO: 5206 - DNA, 15 bp, Homo sapiens
gctacaaaagtttca

SEQ ID NO: 5207 - DNA, 15 bp, Homo sapiens
agctacaaaagtttc

SEQ ID NO: 5208 - DNA, 15 bp, Homo sapiens
aagctacaaaagttt

SEQ ID NO: 5209 - DNA, 15 bp, Homo sapiens
taagctacaaaagtt

SEQ ID NO: 5210 - DNA, 15 bp, Homo sapiens
ttaagctacaaaagt

SEQ ID NO: 5211 - DNA, 15 bp, Homo sapiens
tttaagctacaaaag

SEQ ID NO: 5212 - DNA, 15 bp, Homo sapiens
atttaagctacaaaa

SEQ ID NO: 5213 - DNA, 15 bp, Homo sapiens
tatttaagctacaaa

SEQ ID NO: 5214 - DNA, 15 bp, Homo sapiens
gtatttaagctacaa

SEQ ID NO: 5215 - DNA, 15 bp, Homo sapiens
tgtatttaagctaca

SEQ ID NO: 5216 - DNA, 15 bp, Homo sapiens
gtgtatttaagctac

SEQ ID NO: 5217 - DNA, 15 bp, Homo sapiens
tgtgtatttaagcta

SEQ ID NO: 5218 - DNA, 15 bp, Homo sapiens
ttgtgtatttaagct

SEQ ID NO: 5219 - DNA, 15 bp, Homo sapiens
cttgtgtatttaagc

SEQ ID NO: 5220 - DNA, 15 bp, Homo sapiens
tcttgtgtatttaag

SEQ ID NO: 5221 - DNA, 15 bp, Homo sapiens
ttcttgtgtatttaa

SEQ ID NO: 5222 - DNA, 15 bp, Homo sapiens
attcttgtgtattta

SEQ ID NO: 5223 - DNA, 15 bp, Homo sapiens
aattcttgtgtattt

SEQ ID NO: 5224 - DNA, 15 bp, Homo sapiens
aaattcttgtgtatt

SEQ ID NO: 5225 - DNA, 15 bp, Homo sapiens
aaaattcttgtgtat

SEQ ID NO: 5226 - DNA, 15 bp, Homo sapiens
aaaaattcttgtgta

SEQ ID NO: 5227 - DNA, 15 bp, Homo sapiens
aaaaaattcttgtgt

SEQ ID NO: 5228 - DNA, 15 bp, Homo sapiens
caaaaaattcttgtg

SEQ ID NO: 5229 - DNA, 15 bp, Homo sapiens
tcaaaaaattcttgt

SEQ ID NO: 5230 - DNA, 15 bp, Homo sapiens
ttcaaaaaattcttg

SEQ ID NO: 5231 - DNA, 15 bp, Homo sapiens
tttcaaaaaattctt

SEQ ID NO: 5232 - DNA, 15 bp, Homo sapiens
ttttcaaaaaattct

SEQ ID NO: 5233 - DNA, 15 bp, Homo sapiens
cttttcaaaaaattc

SEQ ID NO: 5234 - DNA, 15 bp, Homo sapiens
ccttttcaaaaaatt

SEQ ID NO: 5235 - DNA, 15 bp, Homo sapiens
tccttttcaaaaaat

SEQ ID NO: 5236 - DNA, 15 bp, Homo sapiens
ttccttttcaaaaaa

SEQ ID NO: 5237 - DNA, 15 bp, Homo sapiens
tttccttttcaaaaa

SEQ ID NO: 5238 - DNA, 15 bp, Homo sapiens
atttccttttcaaaa

SEQ ID NO: 5239 - DNA, 15 bp, Homo sapiens
tatttccttttcaaa

SEQ ID NO: 5240 - DNA, 15 bp, Homo sapiens
ttatttccttttcaa

SEQ ID NO: 5241 - DNA, 15 bp, Homo sapiens
cttatttccttttca

SEQ ID NO: 5242 - DNA, 15 bp, Homo sapiens
tcttatttccttttc

SEQ ID NO: 5243 - DNA, 15 bp, Homo sapiens
atcttatttcctttt

SEQ ID NO: 5244 - DNA, 15 bp, Homo sapiens
tatcttatttccttt

SEQ ID NO: 5245 - DNA, 15 bp, Homo sapiens
ttatcttatttcctt

SEQ ID NO: 5246 - DNA, 15 bp, Homo sapiens
attatcttatttcct

SEQ ID NO: 5247 - DNA, 15 bp, Homo sapiens
cattatcttatttcc

SEQ ID NO: 5248 - DNA, 15 bp, Homo sapiens
tcattatcttatttc

SEQ ID NO: 5249 - DNA, 15 bp, Homo sapiens
atcattatcttattt

SEQ ID NO: 5250 - DNA, 15 bp, Homo sapiens
catcattatcttatt

SEQ ID NO: 5251 - DNA, 15 bp, Homo sapiens
gcatcattatcttat

SEQ ID NO: 5252 - DNA, 15 bp, Homo sapiens
tgcatcattatctta

SEQ ID NO: 5253 - DNA, 15 bp, Homo sapiens
ttgcatcattatctt

SEQ ID NO: 5254 - DNA, 15 bp, Homo sapiens
tttgcatcattatct

SEQ ID NO: 5255 - DNA, 15 bp, Homo sapiens
ttttgcatcattatc

SEQ ID NO: 5256 - DNA, 15 bp, Homo sapiens
attttgcatcattat

SEQ ID NO: 5257 - DNA, 15 bp, Homo sapiens
tattttgcatcatta

SEQ ID NO: 5258 - DNA, 15 bp, Homo sapiens
ctattttgcatcatt

SEQ ID NO: 5259 - DNA, 15 bp, Homo sapiens
actattttgcatcat

SEQ ID NO: 5260 - DNA, 15 bp, Homo sapiens
aactattttgcatca

SEQ ID NO: 5261 - DNA, 15 bp, Homo sapiens
taactattttgcatc

SEQ ID NO: 5262 - DNA, 15 bp, Homo sapiens
ttaactattttgcat

SEQ ID NO: 5263 - DNA, 15 bp, Homo sapiens
attaactattttgca

SEQ ID NO: 5264 - DNA, 15 bp, Homo sapiens
aattaactattttgc

SEQ ID NO: 5265 - DNA, 15 bp, Homo sapiens
aaattaactattttg

SEQ ID NO: 5266 - DNA, 15 bp, Homo sapiens
aaaattaactatttt

SEQ ID NO: 5267 - DNA, 15 bp, Homo sapiens
aaaaattaactattt

SEQ ID NO: 5268 - DNA, 15 bp, Homo sapiens
aaaaaattaactatt

SEQ ID NO: 5269 - DNA, 15 bp, Homo sapiens
taaaaaattaactat

SEQ ID NO: 5270 - DNA, 15 bp, Homo sapiens
ttaaaaaattaacta

SEQ ID NO: 5271 - DNA, 15 bp, Homo sapiens
tttaaaaaattaact

SEQ ID NO: 5272 - DNA, 15 bp, Homo sapiens
ttttaaaaaattaac

SEQ ID NO: 5273 - DNA, 15 bp, Homo sapiens
tttttaaaaaattaa

SEQ ID NO: 5274 - DNA, 15 bp, Homo sapiens
ttttttaaaaaatta

SEQ ID NO: 5275 - DNA, 15 bp, Homo sapiens
tttttttaaaaaatt

SEQ ID NO: 5276 - DNA, 15 bp, Homo sapiens
atttttttaaaaaat

SEQ ID NO: 5277 - DNA, 15 bp, Homo sapiens
catttttttaaaaaa

SEQ ID NO: 5278 - DNA, 15 bp, Homo sapiens
acatttttttaaaaa

SEQ ID NO: 5279 - DNA, 15 bp, Homo sapiens
aacatttttttaaaa

SEQ ID NO: 5280 - DNA, 15 bp, Homo sapiens
taacatttttttaaa

SEQ ID NO: 5281 - DNA, 15 bp, Homo sapiens
ctaacatttttttaa

SEQ ID NO: 5282 - DNA, 15 bp, Homo sapiens
tctaacattttttta

SEQ ID NO: 5283 - DNA, 15 bp, Homo sapiens
gtctaacattttttt

SEQ ID NO: 5284 - DNA, 15 bp, Homo sapiens
tgtctaacatttttt

SEQ ID NO: 5285 - DNA, 15 bp, Homo sapiens
gtgtctaacattttt

SEQ ID NO: 5286 - DNA, 15 bp, Homo sapiens
agtgtctaacatttt

SEQ ID NO: 5287 - DNA, 15 bp, Homo sapiens
cagtgtctaacattt

SEQ ID NO: 5288 - DNA, 15 bp, Homo sapiens
gcagtgtctaacatt

SEQ ID NO: 5289 - DNA, 15 bp, Homo sapiens
tgcagtgtctaacat

SEQ ID NO: 5290 - DNA, 15 bp, Homo sapiens
ctgcagtgtctaaca

SEQ ID NO: 5291 - DNA, 15 bp, Homo sapiens
actgcagtgtctaac

SEQ ID NO: 5292 - DNA, 15 bp, Homo sapiens
cactgcagtgtctaa

SEQ ID NO: 5293 - DNA, 15 bp, Homo sapiens
ccactgcagtgtcta

SEQ ID NO: 5294 - DNA, 15 bp, Homo sapiens
tccactgcagtgtct

SEQ ID NO: 5295 - DNA, 15 bp, Homo sapiens
atccactgcagtgtc

SEQ ID NO: 5296 - DNA, 15 bp, Homo sapiens
catccactgcagtgt

SEQ ID NO: 5297 - DNA, 15 bp, Homo sapiens
gcatccactgcagtg

SEQ ID NO: 5298 - DNA, 15 bp, Homo sapiens
tgcatccactgcagt

SEQ ID NO: 5299 - DNA, 15 bp, Homo sapiens
ttgcatccactgcag

SEQ ID NO: 5300 - DNA, 15 bp, Homo sapiens
gttgcatccactgca

SEQ ID NO: 5301 - DNA, 15 bp, Homo sapiens
tgttgcatccactgc

SEQ ID NO: 5302 - DNA, 15 bp, Homo sapiens
ttgttgcatccactg

SEQ ID NO: 5303 - DNA, 15 bp, Homo sapiens
tttgttgcatccact

SEQ ID NO: 5304 - DNA, 15 bp, Homo sapiens
ttttgttgcatccac

SEQ ID NO: 5305 - DNA, 15 bp, Homo sapiens
attttgttgcatcca

SEQ ID NO: 5306 - DNA, 15 bp, Homo sapiens
tattttgttgcatcc

SEQ ID NO: 5307 - DNA, 15 bp, Homo sapiens
gtattttgttgcatc

SEQ ID NO: 5308 - DNA, 15 bp, Homo sapiens
agtattttgttgcat

SEQ ID NO: 5309 - DNA, 15 bp, Homo sapiens
aagtattttgttgca

SEQ ID NO: 5310 - DNA, 15 bp, Homo sapiens
aaagtattttgttgc

SEQ ID NO: 5311 - DNA, 15 bp, Homo sapiens
taaagtattttgttg

SEQ ID NO: 5312 - DNA, 15 bp, Homo sapiens
ataaagtattttgtt

SEQ ID NO: 5313 - DNA, 15 bp, Homo sapiens
tataaagtattttgt

SEQ ID NO: 5314 - DNA, 15 bp, Homo sapiens
atataaagtattttg

SEQ ID NO: 5315 - DNA, 15 bp, Homo sapiens
catataaagtatttt

SEQ ID NO: 5316 - DNA, 15 bp, Homo sapiens
tcatataaagtattt

SEQ ID NO: 5317 - DNA, 15 bp, Homo sapiens
ttcatataaagtatt

SEQ ID NO: 5318 - DNA, 15 bp, Homo sapiens
tttcatataaagtat

SEQ ID NO: 5319 - DNA, 15 bp, Homo sapiens
ctttcatataaagta

SEQ ID NO: 5320 - DNA, 15 bp, Homo sapiens
tctttcatataaagt

SEQ ID NO: 5321 - DNA, 15 bp, Homo sapiens
atctttcatataaag

SEQ ID NO: 5322 - DNA, 15 bp, Homo sapiens
aatctttcatataaa

SEQ ID NO: 5323 - DNA, 15 bp, Homo sapiens
aaatctttcatataa

SEQ ID NO: 5324 - DNA, 15 bp, Homo sapiens
taaatctttcatata

SEQ ID NO: 5325 - DNA, 15 bp, Homo sapiens
ataaatctttcatat

SEQ ID NO: 5326 - DNA, 15 bp, Homo sapiens
gataaatctttcata

SEQ ID NO: 5327 - DNA, 15 bp, Homo sapiens
ggataaatctttcat

SEQ ID NO: 5328 - DNA, 15 bp, Homo sapiens
tggataaatctttca

SEQ ID NO: 5329 - DNA, 15 bp, Homo sapiens
ctggataaatctttc

SEQ ID NO: 5330 - DNA, 15 bp, Homo sapiens
actggataaatcttt

SEQ ID NO: 5331 - DNA, 15 bp, Homo sapiens
aactggataaatctt

SEQ ID NO: 5332 - DNA, 15 bp, Homo sapiens
taactggataaatct

SEQ ID NO: 5333 - DNA, 15 bp, Homo sapiens
ttaactggataaatc

SEQ ID NO: 5334 - DNA, 15 bp, Homo sapiens
gttaactggataaat

SEQ ID NO: 5335 - DNA, 15 bp, Homo sapiens
agttaactggataaa

SEQ ID NO: 5336 - DNA, 15 bp, Homo sapiens
aagttaactggataa

SEQ ID NO: 5337 - DNA, 15 bp, Homo sapiens
aaagttaactggata

SEQ ID NO: 5338 - DNA, 15 bp, Homo sapiens
aaaagttaactggat

SEQ ID NO: 5339 - DNA, 15 bp, Homo sapiens
caaaagttaactgga

SEQ ID NO: 5340 - DNA, 15 bp, Homo sapiens
acaaaagttaactgg

SEQ ID NO: 5341 - DNA, 15 bp, Homo sapiens
cacaaaagttaactg

SEQ ID NO: 5342 - DNA, 15 bp, Homo sapiens
ccacaaaagttaact

SEQ ID NO: 5343 - DNA, 15 bp, Homo sapiens
tccacaaaagttaac

SEQ ID NO: 5344 - DNA, 15 bp, Homo sapiens
ctccacaaaagttaa

SEQ ID NO: 5345 - DNA, 15 bp, Homo sapiens
actccacaaaagtta

SEQ ID NO: 5346 - DNA, 15 bp, Homo sapiens
tactccacaaaagtt

SEQ ID NO: 5347 - DNA, 15 bp, Homo sapiens
atactccacaaaagt

SEQ ID NO: 5348 - DNA, 15 bp, Homo sapiens
aatactccacaaaag

SEQ ID NO: 5349 - DNA, 15 bp, Homo sapiens
taatactccacaaaa

SEQ ID NO: 5350 - DNA, 15 bp, Homo sapiens
ctaatactccacaaa

SEQ ID NO: 5351 - DNA, 15 bp, Homo sapiens
cctaatactccacaa

SEQ ID NO: 5352 - DNA, 15 bp, Homo sapiens
acctaatactccaca

SEQ ID NO: 5353 - DNA, 15 bp, Homo sapiens
tacctaatactccac

SEQ ID NO: 5354 - DNA, 15 bp, Homo sapiens
atacctaatactcca

SEQ ID NO: 5355 - DNA, 15 bp, Homo sapiens
aatacctaatactcc

SEQ ID NO: 5356 - DNA, 15 bp, Homo sapiens
taatacctaatactc

SEQ ID NO: 5357 - DNA, 15 bp, Homo sapiens
ctaatacctaatact

SEQ ID NO: 5358 - DNA, 15 bp, Homo sapiens
tctaatacctaatac

SEQ ID NO: 5359 - DNA, 15 bp, Homo sapiens
gtctaatacctaata

SEQ ID NO: 5360 - DNA, 15 bp, Homo sapiens
agtctaatacctaat

SEQ ID NO: 5361 - DNA, 15 bp, Homo sapiens
tagtctaatacctaa

SEQ ID NO: 5362 - DNA, 15 bp, Homo sapiens
ttagtctaataccta

SEQ ID NO: 5363 - DNA, 15 bp, Homo sapiens
attagtctaatacct

SEQ ID NO: 5364 - DNA, 15 bp, Homo sapiens
tattagtctaatacc

SEQ ID NO: 5365 - DNA, 15 bp, Homo sapiens
ttattagtctaatac

SEQ ID NO: 5366 - DNA, 15 bp, Homo sapiens
attattagtctaata

SEQ ID NO: 5367 - DNA, 15 bp, Homo sapiens
aattattagtctaat

SEQ ID NO: 5368 - DNA, 15 bp, Homo sapiens
taattattagtctaa

SEQ ID NO: 5369 - DNA, 15 bp, Homo sapiens
ctaattattagtcta

SEQ ID NO: 5370 - DNA, 15 bp, Homo sapiens
gctaattattagtct

SEQ ID NO: 5371 - DNA, 15 bp, Homo sapiens
tgctaattattagtc

SEQ ID NO: 5372 - DNA, 15 bp, Homo sapiens
gtgctaattattagt

SEQ ID NO: 5373 - DNA, 15 bp, Homo sapiens
tgtgctaattattag

SEQ ID NO: 5374 - DNA, 15 bp, Homo sapiens
gtgtgctaattatta

SEQ ID NO: 5375 - DNA, 15 bp, Homo sapiens
agtgtgctaattatt

SEQ ID NO: 5376 - DNA, 15 bp, Homo sapiens
aagtgtgctaattat

SEQ ID NO: 5377 - DNA, 15 bp, Homo sapiens
taagtgtgctaatta

SEQ ID NO: 5378 - DNA, 15 bp, Homo sapiens
gtaagtgtgctaatt

SEQ ID NO: 5379 - DNA, 15 bp, Homo sapiens
agtaagtgtgctaat

SEQ ID NO: 5380 - DNA, 15 bp, Homo sapiens
aagtaagtgtgctaa

SEQ ID NO: 5381 - DNA, 15 bp, Homo sapiens
taagtaagtgtgcta

SEQ ID NO: 5382 - DNA, 15 bp, Homo sapiens
ttaagtaagtgtgct

SEQ ID NO: 5383 - DNA, 15 bp, Homo sapiens
cttaagtaagtgtgc

SEQ ID NO: 5384 - DNA, 15 bp, Homo sapiens
acttaagtaagtgtg

SEQ ID NO: 5385 - DNA, 15 bp, Homo sapiens
aacttaagtaagtgt

SEQ ID NO: 5386 - DNA, 15 bp, Homo sapiens
taacttaagtaagtg

SEQ ID NO: 5387 - DNA, 15 bp, Homo sapiens
ctaacttaagtaagt

SEQ ID NO: 5388 - DNA, 15 bp, Homo sapiens
tctaacttaagtaag

SEQ ID NO: 5389 - DNA, 15 bp, Homo sapiens
ttctaacttaagtaa

SEQ ID NO: 5390 - DNA, 15 bp, Homo sapiens
tttctaacttaagta

SEQ ID NO: 5391 - DNA, 15 bp, Homo sapiens
ctttctaacttaagt

SEQ ID NO: 5392 - DNA, 15 bp, Homo sapiens
actttctaacttaag

SEQ ID NO: 5393 - DNA, 15 bp, Homo sapiens
tactttctaacttaa

SEQ ID NO: 5394 - DNA, 15 bp, Homo sapiens
atactttctaactta

SEQ ID NO: 5395 - DNA, 15 bp, Homo sapiens
tatactttctaactt

SEQ ID NO: 5396 - DNA, 15 bp, Homo sapiens
ttatactttctaact

SEQ ID NO: 5397 - DNA, 15 bp, Homo sapiens
attatactttctaac

SEQ ID NO: 5398 - DNA, 15 bp, Homo sapiens
tattatactttctaa

SEQ ID NO: 5399 - DNA, 15 bp, Homo sapiens
ttattatactttcta

SEQ ID NO: 5400 - DNA, 15 bp, Homo sapiens
attattatactttct

SEQ ID NO: 5401 - DNA, 15 bp, Homo sapiens
cattattatactttc

SEQ ID NO: 5402 - DNA, 15 bp, Homo sapiens
gcattattatacttt

SEQ ID NO: 5403 - DNA, 15 bp, Homo sapiens
cgcattattatactt

SEQ ID NO: 5404 - DNA, 15 bp, Homo sapiens
gcgcattattatact

SEQ ID NO: 5405 - DNA, 15 bp, Homo sapiens
ggcgcattattatac

SEQ ID NO: 5406 - DNA, 15 bp, Homo sapiens
cggcgcattattata

SEQ ID NO: 5407 - DNA, 15 bp, Homo sapiens
ccggcgcattattat

SEQ ID NO: 5408 - DNA, 15 bp, Homo sapiens
tccggcgcattatta

SEQ ID NO: 5409 - DNA, 15 bp, Homo sapiens
gtccggcgcattatt

SEQ ID NO: 5410 - DNA, 15 bp, Homo sapiens
cgtccggcgcattat

SEQ ID NO: 5411 - DNA, 15 bp, Homo sapiens
gcgtccggcgcatta

SEQ ID NO: 5412 - DNA, 15 bp, Homo sapiens
cgcgtccggcgcatt

SEQ ID NO: 5413 - DNA, 15 bp, Homo sapiens
ccgcgtccggcgcat

SEQ ID NO: 5414 - DNA, 15 bp, Homo sapiens
accgcgtccggcgca

SEQ ID NO: 5415 - DNA, 15 bp, Homo sapiens
taccgcgtccggcgc

SEQ ID NO: 5416 - DNA, 15 bp, Homo sapiens
ctaccgcgtccggcg

SEQ ID NO: 5417 - DNA, 15 bp, Homo sapiens
gctaccgcgtccggc

SEQ ID NO: 5418 - DNA, 15 bp, Homo sapiens
agctaccgcgtccgg

SEQ ID NO: 5419 - DNA, 15 bp, Homo sapiens
gagctaccgcgtccg

SEQ ID NO: 5420 - DNA, 15 bp, Homo sapiens
tgagctaccgcgtcc

SEQ ID NO: 5421 - DNA, 15 bp, Homo sapiens
gtgagctaccgcgtc

SEQ ID NO: 5422 - DNA, 15 bp, Homo sapiens
cgtgagctaccgcgt

SEQ ID NO: 5423 - DNA, 15 bp, Homo sapiens
gcgtgagctaccgcg

SEQ ID NO: 5424 - DNA, 15 bp, Homo sapiens
ggcgtgagctaccgc

SEQ ID NO: 5425 - DNA, 15 bp, Homo sapiens
aggcgtgagctaccg

SEQ ID NO: 5426 - DNA, 15 bp, Homo sapiens
caggcgtgagctacc

SEQ ID NO: 5427 - DNA, 15 bp, Homo sapiens
acaggcgtgagctac

SEQ ID NO: 5428 - DNA, 15 bp, Homo sapiens
tacaggcgtgagcta

SEQ ID NO: 5429 - DNA, 15 bp, Homo sapiens
ttacaggcgtgagct

SEQ ID NO: 5430 - DNA, 15 bp, Homo sapiens
tggcctcccaaagtg

SEQ ID NO: 5431 - DNA, 15 bp, Homo sapiens
ttggcctcccaaagt

SEQ ID NO: 5432 - DNA, 15 bp, Homo sapiens
cttggcctcccaaag

SEQ ID NO: 5433 - DNA, 15 bp, Homo sapiens
ccttggcctcccaaa

SEQ ID NO: 5434 - DNA, 15 bp, Homo sapiens
accttggcctcccaa

SEQ ID NO: 5435 - DNA, 15 bp, Homo sapiens
caccttggcctccca

SEQ ID NO: 5436 - DNA, 15 bp, Homo sapiens
ccaccttggcctccc

SEQ ID NO: 5437 - DNA, 15 bp, Homo sapiens
cccaccttggcctcc

SEQ ID NO: 5438 - DNA, 15 bp, Homo sapiens
gcccaccttggcctc

SEQ ID NO: 5439 - DNA, 15 bp, Homo sapiens
cgcccaccttggcct

SEQ ID NO: 5440 - DNA, 15 bp, Homo sapiens
ccgcccaccttggcc

SEQ ID NO: 5441 - DNA, 15 bp, Homo sapiens
tccgcccaccttggc

SEQ ID NO: 5442 - DNA, 15 bp, Homo sapiens
atccgcccaccttgg

SEQ ID NO: 5443 - DNA, 15 bp, Homo sapiens
gatccgcccaccttg

SEQ ID NO: 5444 - DNA, 15 bp, Homo sapiens
tgatccgcccacctt

SEQ ID NO: 5445 - DNA, 15 bp, Homo sapiens
gtgatccgcccacct

SEQ ID NO: 5446 - DNA, 15 bp, Homo sapiens
tgtgatccgcccacc

SEQ ID NO: 5447 - DNA, 15 bp, Homo sapiens
ttgtgatccgcccac

SEQ ID NO: 5448 - DNA, 15 bp, Homo sapiens
cttgtgatccgccca

SEQ ID NO: 5449 - DNA, 15 bp, Homo sapiens
tggggtttcaccgtg

SEQ ID NO: 5450 - DNA, 15 bp, Homo sapiens
atggggtttcaccgt

SEQ ID NO: 5451 - DNA, 15 bp, Homo sapiens
gatggggtttcaccg

SEQ ID NO: 5452 - DNA, 15 bp, Homo sapiens
gagatggggtttcac

SEQ ID NO: 5453 - DNA, 15 bp, Homo sapiens
agagatggggtttca

SEQ ID NO: 5454 - DNA, 15 bp, Homo sapiens
gtagagatggggttt

SEQ ID NO: 5455 - DNA, 15 bp, Homo sapiens
agtagagatggggtt

SEQ ID NO: 5456 - DNA, 15 bp, Homo sapiens
cagtagagatggggt

SEQ ID NO: 5457 - DNA, 15 bp, Homo sapiens
tcagtagagatgggg

SEQ ID NO: 5458 - DNA, 15 bp, Homo sapiens
ttcagtagagatggg

SEQ ID NO: 5459 - DNA, 15 bp, Homo sapiens
tttcagtagagatgg

SEQ ID NO: 5460 - DNA, 15 bp, Homo sapiens
ttttcagtagagatg

SEQ ID NO: 5461 - DNA, 15 bp, Homo sapiens
attttcagtagagat

SEQ ID NO: 5462 - DNA, 15 bp, Homo sapiens
tattttcagtagaga

SEQ ID NO: 5463 - DNA, 15 bp, Homo sapiens
gtattttcagtagag

SEQ ID NO: 5464 - DNA, 15 bp, Homo sapiens
tgtattttcagtaga

SEQ ID NO: 5465 - DNA, 15 bp, Homo sapiens
ttgtattttcagtag

SEQ ID NO: 5466 - DNA, 15 bp, Homo sapiens
tttgtattttcagta

SEQ ID NO: 5467 - DNA, 15 bp, Homo sapiens
ttttgtattttcagt

SEQ ID NO: 5468 - DNA, 15 bp, Homo sapiens
tttttgtattttcag

SEQ ID NO: 5469 - DNA, 15 bp, Homo sapiens
ttttttgtattttca

SEQ ID NO: 5470 - DNA, 15 bp, Homo sapiens
tttttttgtattttc

SEQ ID NO: 5471 - DNA, 15 bp, Homo sapiens
atttttttgtatttt

SEQ ID NO: 5472 - DNA, 15 bp, Homo sapiens
aatttttttgtattt

SEQ ID NO: 5473 - DNA, 15 bp, Homo sapiens
aaatttttttgtatt

SEQ ID NO: 5474 - DNA, 15 bp, Homo sapiens
caaatttttttgtat

SEQ ID NO: 5475 - DNA, 15 bp, Homo sapiens
gcaaatttttttgta

SEQ ID NO: 5476 - DNA, 15 bp, Homo sapiens
ggcaaatttttttgt

SEQ ID NO: 5477 - DNA, 15 bp, Homo sapiens
cggcaaatttttttg

SEQ ID NO: 5478 - DNA, 15 bp, Homo sapiens
ccggcaaattttttt

SEQ ID NO: 5479 - DNA, 15 bp, Homo sapiens
cccggcaaatttttt

SEQ ID NO: 5480 - DNA, 15 bp, Homo sapiens
gcccggcaaattttt

SEQ ID NO: 5481 - DNA, 15 bp, Homo sapiens
cgcccggcaaatttt

SEQ ID NO: 5482 - DNA, 15 bp, Homo sapiens
acgcccggcaaattt

SEQ ID NO: 5483 - DNA, 15 bp, Homo sapiens
cacgcccggcaaatt

SEQ ID NO: 5484 - DNA, 15 bp, Homo sapiens
tcacgcccggcaaat

SEQ ID NO: 5485 - DNA, 15 bp, Homo sapiens
atcacgcccggcaaa

SEQ ID NO: 5486 - DNA, 15 bp, Homo sapiens
catcacgcccggcaa

SEQ ID NO: 5487 - DNA, 15 bp, Homo sapiens
ccatcacgcccggca

SEQ ID NO: 5488 - DNA, 15 bp, Homo sapiens
gccatcacgcccggc

SEQ ID NO: 5489 - DNA, 15 bp, Homo sapiens
cgccatcacgcccgg

SEQ ID NO: 5490 - DNA, 15 bp, Homo sapiens
ccgccatcacgcccg

SEQ ID NO: 5491 - DNA, 15 bp, Homo sapiens
cccgccatcacgccc

SEQ ID NO: 5492 - DNA, 15 bp, Homo sapiens
gcccgccatcacgcc

SEQ ID NO: 5493 - DNA, 15 bp, Homo sapiens
tgcccgccatcacgc

SEQ ID NO: 5494 - DNA, 15 bp, Homo sapiens
gtgcccgccatcacg

SEQ ID NO: 5495 - DNA, 15 bp, Homo sapiens
ggtgcccgccatcac

SEQ ID NO: 5496 - DNA, 15 bp, Homo sapiens
aggtgcccgccatca

SEQ ID NO: 5497 - DNA, 15 bp, Homo sapiens
caggtgcccgccatc

SEQ ID NO: 5498 - DNA, 15 bp, Homo sapiens
acaggtgcccgccat

SEQ ID NO: 5499 - DNA, 15 bp, Homo sapiens
tacaggtgcccgcca

SEQ ID NO: 5500 - DNA, 15 bp, Homo sapiens
ctacaggtgcccgcc

SEQ ID NO: 5501 - DNA, 15 bp, Homo sapiens
actacaggtgcccgc

SEQ ID NO: 5502 - DNA, 15 bp, Homo sapiens
gactacaggtgcccg

SEQ ID NO: 5503 - DNA, 15 bp, Homo sapiens
ggactacaggtgccc

SEQ ID NO: 5504 - DNA, 15 bp, Homo sapiens
gggactacaggtgcc

SEQ ID NO: 5505 - DNA, 15 bp, Homo sapiens
tgggactacaggtgc

SEQ ID NO: 5506 - DNA, 15 bp, Homo sapiens
ctgggactacaggtg

SEQ ID NO: 5507 - DNA, 15 bp, Homo sapiens
gctgggactacaggt

SEQ ID NO: 5508 - DNA, 15 bp, Homo sapiens
cctcctgcctcagcc

SEQ ID NO: 5509 - DNA, 15 bp, Homo sapiens
tcctcctgcctcagc

SEQ ID NO: 5510 - DNA, 15 bp, Homo sapiens
atcctcctgcctcag

SEQ ID NO: 5511 - DNA, 15 bp, Homo sapiens
catcctcctgcctca

SEQ ID NO: 5512 - DNA, 15 bp, Homo sapiens
ccatcctcctgcctc

SEQ ID NO: 5513 - DNA, 15 bp, Homo sapiens
accatcctcctgcct

SEQ ID NO: 5514 - DNA, 15 bp, Homo sapiens
caccatcctcctgcc

SEQ ID NO: 5515 - DNA, 15 bp, Homo sapiens
acaccatcctcctgc

SEQ ID NO: 5516 - DNA, 15 bp, Homo sapiens
cacaccatcctcctg

SEQ ID NO: 5517 - DNA, 15 bp, Homo sapiens
tcacaccatcctcct

SEQ ID NO: 5518 - DNA, 15 bp, Homo sapiens
ttcacaccatcctcc

SEQ ID NO: 5519 - DNA, 15 bp, Homo sapiens
gttcacaccatcctc

SEQ ID NO: 5520 - DNA, 15 bp, Homo sapiens
ggttcacaccatcct

SEQ ID NO: 5521 - DNA, 15 bp, Homo sapiens
gggttcacaccatcc

SEQ ID NO: 5522 - DNA, 15 bp, Homo sapiens
ggggttcacaccatc

SEQ ID NO: 5523 - DNA, 15 bp, Homo sapiens
cggggttcacaccat

SEQ ID NO: 5524 - DNA, 15 bp, Homo sapiens
ccggggttcacacca

SEQ ID NO: 5525 - DNA, 15 bp, Homo sapiens
tccggggttcacacc

SEQ ID NO: 5526 - DNA, 15 bp, Homo sapiens
ctccggggttcacac

SEQ ID NO: 5527 - DNA, 15 bp, Homo sapiens
cctccggggttcaca

SEQ ID NO: 5528 - DNA, 15 bp, Homo sapiens
gcctccggggttcac

SEQ ID NO: 5529 - DNA, 15 bp, Homo sapiens
tgcctccggggttca

SEQ ID NO: 5530 - DNA, 15 bp, Homo sapiens
ctgcctccggggttc

SEQ ID NO: 5531 - DNA, 15 bp, Homo sapiens
tctgcctccggggtt

SEQ ID NO: 5532 - DNA, 15 bp, Homo sapiens
ctctgcctccggggt

SEQ ID NO: 5533 - DNA, 15 bp, Homo sapiens
gctctgcctccgggg

SEQ ID NO: 5534 - DNA, 15 bp, Homo sapiens
agctctgcctccggg

SEQ ID NO: 5535 - DNA, 15 bp, Homo sapiens
aagctctgcctccgg

SEQ ID NO: 5536 - DNA, 15 bp, Homo sapiens
caagctctgcctccg

SEQ ID NO: 5537 - DNA, 15 bp, Homo sapiens
gcaagctctgcctcc

SEQ ID NO: 5538 - DNA, 15 bp, Homo sapiens
tgcaagctctgcctc

SEQ ID NO: 5539 - DNA, 15 bp, Homo sapiens
ctgcaagctctgcct

SEQ ID NO: 5540 - DNA, 15 bp, Homo sapiens
actgcaagctctgcc

SEQ ID NO: 5541 - DNA, 15 bp, Homo sapiens
cactgcaagctctgc

SEQ ID NO: 5542 - DNA, 15 bp, Homo sapiens
tcactgcaagctctg

SEQ ID NO: 5543 - DNA, 15 bp, Homo sapiens
ctcactgcaagctct

SEQ ID NO: 5544 - DNA, 15 bp, Homo sapiens
actcactgcaagctc

SEQ ID NO: 5545 - DNA, 15 bp, Homo sapiens
gactcactgcaagct

SEQ ID NO: 5546 - DNA, 15 bp, Homo sapiens
tgactcactgcaagc

SEQ ID NO: 5547 - DNA, 15 bp, Homo sapiens
ttgactcactgcaag

SEQ ID NO: 5548 - DNA, 15 bp, Homo sapiens
cttgactcactgcaa

SEQ ID NO: 5549 - DNA, 15 bp, Homo sapiens
tcttgactcactgca

SEQ ID NO: 5550 - DNA, 15 bp, Homo sapiens
atcttgactcactgc

SEQ ID NO: 5551 - DNA, 15 bp, Homo sapiens
gatcttgactcactg

SEQ ID NO: 5552 - DNA, 15 bp, Homo sapiens
cgatcttgactcact

SEQ ID NO: 5553 - DNA, 15 bp, Homo sapiens
acgatcttgactcac

SEQ ID NO: 5554 - DNA, 15 bp, Homo sapiens
cacgatcttgactca

SEQ ID NO: 5555 - DNA, 15 bp, Homo sapiens
gcacgatcttgactc

SEQ ID NO: 5556 - DNA, 15 bp, Homo sapiens
ggcacgatcttgact

SEQ ID NO: 5557 - DNA, 15 bp, Homo sapiens
tggcacgatcttgac

SEQ ID NO: 5558 - DNA, 15 bp, Homo sapiens
gtggcacgatcttga

SEQ ID NO: 5559 - DNA, 15 bp, Homo sapiens
agtggcacgatcttg

SEQ ID NO: 5560 - DNA, 15 bp, Homo sapiens
cagtggcacgatctt

SEQ ID NO: 5561 - DNA, 15 bp, Homo sapiens
gcagtggcacgatct

SEQ ID NO: 5562 - DNA, 15 bp, Homo sapiens
tgcagtggcacgatc

SEQ ID NO: 5563 - DNA, 15 bp, Homo sapiens
gtgcagtggcacgat

SEQ ID NO: 5564 - DNA, 15 bp, Homo sapiens
agtgcagtggcacga

SEQ ID NO: 5565 - DNA, 15 bp, Homo sapiens
gagtgcagtggcacg

SEQ ID NO: 5566 - DNA, 15 bp, Homo sapiens
ttggagtgcagtggc

SEQ ID NO: 5567 - DNA, 15 bp, Homo sapiens
gttggagtgcagtgg

SEQ ID NO: 5568 - DNA, 15 bp, Homo sapiens
ggttggagtgcagtg

SEQ ID NO: 5569 - DNA, 15 bp, Homo sapiens
aggttggagtgcagt

SEQ ID NO: 5570 - DNA, 15 bp, Homo sapiens
caggttggagtgcag

SEQ ID NO: 5571 - DNA, 15 bp, Homo sapiens
ccaggttggagtgca

SEQ ID NO: 5572 - DNA, 15 bp, Homo sapiens
cccaggttggagtgc

SEQ ID NO: 5573 - DNA, 15 bp, Homo sapiens
gcccaggttggagtg

SEQ ID NO: 5574 - DNA, 15 bp, Homo sapiens
cgcccaggttggagt

SEQ ID NO: 5575 - DNA, 15 bp, Homo sapiens
tcgcccaggttggag

SEQ ID NO: 5576 - DNA, 15 bp, Homo sapiens
gtcgcccaggttgga

SEQ ID NO: 5577 - DNA, 15 bp, Homo sapiens
tgtcgcccaggttgg

SEQ ID NO: 5578 - DNA, 15 bp, Homo sapiens
ctgtcgcccaggttg

SEQ ID NO: 5579 - DNA, 15 bp, Homo sapiens
tctgtcgcccaggtt

SEQ ID NO: 5580 - DNA, 15 bp, Homo sapiens
ttctgtcgcccaggt

SEQ ID NO: 5581 - DNA, 15 bp, Homo sapiens
attctgtcgcccagg

SEQ ID NO: 5582 - DNA, 15 bp, Homo sapiens
cattctgtcgcccag

SEQ ID NO: 5583 - DNA, 15 bp, Homo sapiens
tcattctgtcgccca

SEQ ID NO: 5584 - DNA, 15 bp, Homo sapiens
ctcattctgtcgccc

SEQ ID NO: 5585 - DNA, 15 bp, Homo sapiens
tctcattctgtcgcc

SEQ ID NO: 5586 - DNA, 15 bp, Homo sapiens
gtctcattctgtcgc

SEQ ID NO: 5587 - DNA, 15 bp, Homo sapiens
agtctcattctgtcg

SEQ ID NO: 5588 - DNA, 15 bp, Homo sapiens
gagatggagtctcat

SEQ ID NO: 5589 - DNA, 15 bp, Homo sapiens
ttgagatggagtctc

SEQ ID NO: 5590 - DNA, 15 bp, Homo sapiens
tttgagatggagtct

SEQ ID NO: 5591 - DNA, 15 bp, Homo sapiens
gtttgagatggagtc

SEQ ID NO: 5592 - DNA, 15 bp, Homo sapiens
tgtttgagatggagt

SEQ ID NO: 5593 - DNA, 15 bp, Homo sapiens
ttgtttgagatggag

SEQ ID NO: 5594 - DNA, 15 bp, Homo sapiens
tttgtttgagatgga

SEQ ID NO: 5595 - DNA, 15 bp, Homo sapiens
ttttgtttgagatgg

SEQ ID NO: 5596 - DNA, 15 bp, Homo sapiens
tttttgtttgagatg

SEQ ID NO: 5597 - DNA, 15 bp, Homo sapiens
ttttttgtttgagat

SEQ ID NO: 5598 - DNA, 15 bp, Homo sapiens
tttttttgtttgaga

SEQ ID NO: 5599 - DNA, 15 bp, Homo sapiens
gtttttttgtttgag

SEQ ID NO: 5600 - DNA, 15 bp, Homo sapiens
tgtttttttgtttga

SEQ ID NO: 5601 - DNA, 15 bp, Homo sapiens
ttgtttttttgtttg

SEQ ID NO: 5602 - DNA, 15 bp, Homo sapiens
tttgtttttttgttt

SEQ ID NO: 5603 - DNA, 15 bp, Homo sapiens
ttttgtttttttgtt

SEQ ID NO: 5604 - DNA, 15 bp, Homo sapiens
gttttgtttttttgt

SEQ ID NO: 5605 - DNA, 15 bp, Homo sapiens
tgttttgtttttttg

SEQ ID NO: 5606 - DNA, 15 bp, Homo sapiens
ttgttttgttttttt

SEQ ID NO: 5607 - DNA, 15 bp, Homo sapiens
tttgttttgtttttt

SEQ ID NO: 5608 - DNA, 15 bp, Homo sapiens
ttttgttttgttttt

SEQ ID NO: 5609 - DNA, 15 bp, Homo sapiens
cttttttttgttttg

SEQ ID NO: 5610 - DNA, 15 bp, Homo sapiens
acttttttttgtttt

SEQ ID NO: 5611 - DNA, 15 bp, Homo sapiens
cacttttttttgttt

SEQ ID NO: 5612 - DNA, 15 bp, Homo sapiens
acacttttttttgtt

SEQ ID NO: 5613 - DNA, 15 bp, Homo sapiens
tacacttttttttgt

SEQ ID NO: 5614 - DNA, 15 bp, Homo sapiens
ttacacttttttttg

SEQ ID NO: 5615 - DNA, 15 bp, Homo sapiens
attacactttttttt

SEQ ID NO: 5616 - DNA, 15 bp, Homo sapiens
tattacacttttttt

SEQ ID NO: 5617 - DNA, 15 bp, Homo sapiens
ttattacactttttt

SEQ ID NO: 5618 - DNA, 15 bp, Homo sapiens
attattacacttttt

SEQ ID NO: 5619 - DNA, 15 bp, Homo sapiens
tattattacactttt

SEQ ID NO: 5620 - DNA, 15 bp, Homo sapiens
ttattattacacttt

SEQ ID NO: 5621 - DNA, 15 bp, Homo sapiens
attattattacactt

SEQ ID NO: 5622 - DNA, 15 bp, Homo sapiens
aattattattacact

SEQ ID NO: 5623 - DNA, 15 bp, Homo sapiens
aaattattattacac

SEQ ID NO: 5624 - DNA, 15 bp, Homo sapiens
taaattattattaca

SEQ ID NO: 5625 - DNA, 15 bp, Homo sapiens
ataaattattattac

SEQ ID NO: 5626 - DNA, 15 bp, Homo sapiens
gataaattattatta

SEQ ID NO: 5627 - DNA, 15 bp, Homo sapiens
tgataaattattatt

SEQ ID NO: 5628 - DNA, 15 bp, Homo sapiens
atgataaattattat

SEQ ID NO: 5629 - DNA, 15 bp, Homo sapiens
aatgataaattatta

SEQ ID NO: 5630 - DNA, 15 bp, Homo sapiens
taatgataaattatt

SEQ ID NO: 5631 - DNA, 15 bp, Homo sapiens
ctaatgataaattat

SEQ ID NO: 5632 - DNA, 15 bp, Homo sapiens
gctaatgataaatta

SEQ ID NO: 5633 - DNA, 15 bp, Homo sapiens
agctaatgataaatt

SEQ ID NO: 5634 - DNA, 15 bp, Homo sapiens
cagctaatgataaat

SEQ ID NO: 5635 - DNA, 15 bp, Homo sapiens
ccagctaatgataaa

SEQ ID NO: 5636 - DNA, 15 bp, Homo sapiens
tccagctaatgataa

SEQ ID NO: 5637 - DNA, 15 bp, Homo sapiens
atccagctaatgata

SEQ ID NO: 5638 - DNA, 15 bp, Homo sapiens
catccagctaatgat

SEQ ID NO: 5639 - DNA, 15 bp, Homo sapiens
tcatccagctaatga

SEQ ID NO: 5640 - DNA, 15 bp, Homo sapiens
atcatccagctaatg

SEQ ID NO: 5641 - DNA, 15 bp, Homo sapiens
tatcatccagctaat

SEQ ID NO: 5642 - DNA, 15 bp, Homo sapiens
atatcatccagctaa

SEQ ID NO: 5643 - DNA, 15 bp, Homo sapiens
catatcatccagcta

SEQ ID NO: 5644 - DNA, 15 bp, Homo sapiens
gcatatcatccagct

SEQ ID NO: 5645 - DNA, 15 bp, Homo sapiens
agcatatcatccagc

SEQ ID NO: 5646 - DNA, 15 bp, Homo sapiens
cagcatatcatccag

SEQ ID NO: 5647 - DNA, 15 bp, Homo sapiens
acagcatatcatcca

SEQ ID NO: 5648 - DNA, 15 bp, Homo sapiens
aacagcatatcatcc

SEQ ID NO: 5649 - DNA, 15 bp, Homo sapiens
caacagcatatcatc

SEQ ID NO: 5650 - DNA, 15 bp, Homo sapiens
acaacagcatatcat

SEQ ID NO: 5651 - DNA, 15 bp, Homo sapiens
aacaacagcatatca

SEQ ID NO: 5652 - DNA, 15 bp, Homo sapiens
aaacaacagcatatc

SEQ ID NO: 5653 - DNA, 15 bp, Homo sapiens
gaaacaacagcatat

SEQ ID NO: 5654 - DNA, 15 bp, Homo sapiens
ggaaacaacagcata

SEQ ID NO: 5655 - DNA, 15 bp, Homo sapiens
gggaaacaacagcat

SEQ ID NO: 5656 - DNA, 15 bp, Homo sapiens
tgggaaacaacagca

SEQ ID NO: 5657 - DNA, 15 bp, Homo sapiens
atgggaaacaacagc

SEQ ID NO: 5658 - DNA, 15 bp, Homo sapiens
catgggaaacaacag

SEQ ID NO: 5659 - DNA, 15 bp, Homo sapiens
acatgggaaacaaca

SEQ ID NO: 5660 - DNA, 15 bp, Homo sapiens
gacatgggaaacaac

SEQ ID NO: 5661 - DNA, 15 bp, Homo sapiens
tgacatgggaaacaa

SEQ ID NO: 5662 - DNA, 15 bp, Homo sapiens
gtgacatgggaaaca

SEQ ID NO: 5663 - DNA, 15 bp, Homo sapiens
ggtgacatgggaaac

SEQ ID NO: 5664 - DNA, 15 bp, Homo sapiens
aggtgacatgggaaa

SEQ ID NO: 5665 - DNA, 15 bp, Homo sapiens
caggtgacatgggaa

SEQ ID NO: 5666 - DNA, 15 bp, Homo sapiens
acaggtgacatggga

SEQ ID NO: 5667 - DNA, 15 bp, Homo sapiens
tacaggtgacatggg

SEQ ID NO: 5668 - DNA, 15 bp, Homo sapiens
atacaggtgacatgg

SEQ ID NO: 5669 - DNA, 15 bp, Homo sapiens
tatacaggtgacatg

SEQ ID NO: 5670 - DNA, 15 bp, Homo sapiens
ttatacaggtgacat

SEQ ID NO: 5671 - DNA, 15 bp, Homo sapiens
cttatacaggtgaca

SEQ ID NO: 5672 - DNA, 15 bp, Homo sapiens
tcttatacaggtgac

SEQ ID NO: 5673 - DNA, 15 bp, Homo sapiens
atcttatacaggtga

SEQ ID NO: 5674 - DNA, 15 bp, Homo sapiens
tatcttatacaggtg

SEQ ID NO: 5675 - DNA, 15 bp, Homo sapiens
atatcttatacaggt

SEQ ID NO: 5676 - DNA, 15 bp, Homo sapiens
catatcttatacagg

SEQ ID NO: 5677 - DNA, 15 bp, Homo sapiens
acatatcttatacag

SEQ ID NO: 5678 - DNA, 15 bp, Homo sapiens
tacatatcttataca

SEQ ID NO: 5679 - DNA, 15 bp, Homo sapiens
ttacatatcttatac

SEQ ID NO: 5680 - DNA, 15 bp, Homo sapiens
tttacatatcttata

SEQ ID NO: 5681 - DNA, 15 bp, Homo sapiens
ttttacatatcttat

SEQ ID NO: 5682 - DNA, 15 bp, Homo sapiens
attttacatatctta

SEQ ID NO: 5683 - DNA, 15 bp, Homo sapiens
tattttacatatctt

SEQ ID NO: 5684 - DNA, 15 bp, Homo sapiens
ttattttacatatct

SEQ ID NO: 5685 - DNA, 15 bp, Homo sapiens
cttattttacatatc

SEQ ID NO: 5686 - DNA, 15 bp, Homo sapiens
tcttattttacatat

SEQ ID NO: 5687 - DNA, 15 bp, Homo sapiens
ttcttattttacata

SEQ ID NO: 5688 - DNA, 15 bp, Homo sapiens
gttcttattttacat

SEQ ID NO: 5689 - DNA, 15 bp, Homo sapiens
tgttcttattttaca

SEQ ID NO: 5690 - DNA, 15 bp, Homo sapiens
gtgttcttattttac

SEQ ID NO: 5691 - DNA, 15 bp, Homo sapiens
tgtgttcttatttta

SEQ ID NO: 5692 - DNA, 15 bp, Homo sapiens
atgtgttcttatttt

SEQ ID NO: 5693 - DNA, 15 bp, Homo sapiens
aatgtgttcttattt

SEQ ID NO: 5694 - DNA, 15 bp, Homo sapiens
taatgtgttcttatt

SEQ ID NO: 5695 - DNA, 15 bp, Homo sapiens
ataatgtgttcttat

SEQ ID NO: 5696 - DNA, 15 bp, Homo sapiens
aataatgtgttctta

SEQ ID NO: 5697 - DNA, 15 bp, Homo sapiens
aaataatgtgttctt

SEQ ID NO: 5698 - DNA, 15 bp, Homo sapiens
taaataatgtgttct

SEQ ID NO: 5699 - DNA, 15 bp, Homo sapiens
gtaaataatgtgttc

SEQ ID NO: 5700 - DNA, 15 bp, Homo sapiens
tgtaaataatgtgtt

SEQ ID NO: 5701 - DNA, 15 bp, Homo sapiens
atgtaaataatgtgt

SEQ ID NO: 5702 - DNA, 15 bp, Homo sapiens
gatgtaaataatgtg

SEQ ID NO: 5703 - DNA, 15 bp, Homo sapiens
agatgtaaataatgt

SEQ ID NO: 5704 - DNA, 15 bp, Homo sapiens
tagatgtaaataatg

SEQ ID NO: 5705 - DNA, 15 bp, Homo sapiens
ttagatgtaaataat

SEQ ID NO: 5706 - DNA, 15 bp, Homo sapiens
attagatgtaaataa

SEQ ID NO: 5707 - DNA, 15 bp, Homo sapiens
tattagatgtaaata

SEQ ID NO: 5708 - DNA, 15 bp, Homo sapiens
atattagatgtaaat

SEQ ID NO: 5709 - DNA, 15 bp, Homo sapiens
tatattagatgtaaa

SEQ ID NO: 5710 - DNA, 15 bp, Homo sapiens
ctatattagatgtaa

SEQ ID NO: 5711 - DNA, 15 bp, Homo sapiens
tctatattagatgta

SEQ ID NO: 5712 - DNA, 15 bp, Homo sapiens
atctatattagatgt

SEQ ID NO: 5713 - DNA, 15 bp, Homo sapiens
tatctatattagatg

SEQ ID NO: 5714 - DNA, 15 bp, Homo sapiens
ttatctatattagat

SEQ ID NO: 5715 - DNA, 15 bp, Homo sapiens
tttatctatattaga

SEQ ID NO: 5716 - DNA, 15 bp, Homo sapiens
ttttatctatattag

SEQ ID NO: 5717 - DNA, 15 bp, Homo sapiens
attttatctatatta

SEQ ID NO: 5718 - DNA, 15 bp, Homo sapiens
gattttatctatatt

SEQ ID NO: 5719 - DNA, 15 bp, Homo sapiens
ggattttatctatat

SEQ ID NO: 5720 - DNA, 15 bp, Homo sapiens
aggattttatctata

SEQ ID NO: 5721 - DNA, 15 bp, Homo sapiens
caggattttatctat

SEQ ID NO: 5722 - DNA, 15 bp, Homo sapiens
tcaggattttatcta

SEQ ID NO: 5723 - DNA, 15 bp, Homo sapiens
ctcaggattttatct

SEQ ID NO: 5724 - DNA, 15 bp, Homo sapiens
cctcaggattttatc

SEQ ID NO: 5725 - DNA, 15 bp, Homo sapiens
gcctcaggattttat

SEQ ID NO: 5726 - DNA, 15 bp, Homo sapiens
cgcctcaggatttta

SEQ ID NO: 5727 - DNA, 15 bp, Homo sapiens
gcgcctcaggatttt

SEQ ID NO: 5728 - DNA, 15 bp, Homo sapiens
agcgcctcaggattt

SEQ ID NO: 5729 - DNA, 15 bp, Homo sapiens
gagcgcctcaggatt

SEQ ID NO: 5730 - DNA, 15 bp, Homo sapiens
agagcgcctcaggat

SEQ ID NO: 5731 - DNA, 15 bp, Homo sapiens
gagagcgcctcagga

SEQ ID NO: 5732 - DNA, 15 bp, Homo sapiens
tgagagcgcctcagg

SEQ ID NO: 5733 - DNA, 15 bp, Homo sapiens
ctgagagcgcctcag

SEQ ID NO: 5734 - DNA, 15 bp, Homo sapiens
tctgagagcgcctca

SEQ ID NO: 5735 - DNA, 15 bp, Homo sapiens
atctgagagcgcctc

SEQ ID NO: 5736 - DNA, 15 bp, Homo sapiens
aatctgagagcgcct

SEQ ID NO: 5737 - DNA, 15 bp, Homo sapiens
caatctgagagcgcc

SEQ ID NO: 5738 - DNA, 15 bp, Homo sapiens
acaatctgagagcgc

SEQ ID NO: 5739 - DNA, 15 bp, Homo sapiens
aacaatctgagagcg

SEQ ID NO: 5740 - DNA, 15 bp, Homo sapiens
aaacaatctgagagc

SEQ ID NO: 5741 - DNA, 15 bp, Homo sapiens
aaaacaatctgagag

SEQ ID NO: 5742 - DNA, 15 bp, Homo sapiens
caaaacaatctgaga

SEQ ID NO: 5743 - DNA, 15 bp, Homo sapiens
acaaaacaatctgag

SEQ ID NO: 5744 - DNA, 15 bp, Homo sapiens
tacaaaacaatctga

SEQ ID NO: 5745 - DNA, 15 bp, Homo sapiens
ctacaaaacaatctg

SEQ ID NO: 5746 - DNA, 15 bp, Homo sapiens
tctacaaaacaatct

SEQ ID NO: 5747 - DNA, 15 bp, Homo sapiens
ctctacaaaacaatc

SEQ ID NO: 5748 - DNA, 15 bp, Homo sapiens
actctacaaaacaat

SEQ ID NO: 5749 - DNA, 15 bp, Homo sapiens
aactctacaaaacaa

SEQ ID NO: 5750 - DNA, 15 bp, Homo sapiens
gaactctacaaaaca

SEQ ID NO: 5751 - DNA, 15 bp, Homo sapiens
tgaactctacaaaac

SEQ ID NO: 5752 - DNA, 15 bp, Homo sapiens
ttgaactctacaaaa

SEQ ID NO: 5753 - DNA, 15 bp, Homo sapiens
tttgaactctacaaa

SEQ ID NO: 5754 - DNA, 15 bp, Homo sapiens
atttgaactctacaa

SEQ ID NO: 5755 - DNA, 15 bp, Homo sapiens
catttgaactctaca

SEQ ID NO: 5756 - DNA, 15 bp, Homo sapiens
acatttgaactctac

SEQ ID NO: 5757 - DNA, 15 bp, Homo sapiens
tacatttgaactcta

SEQ ID NO: 5758 - DNA, 15 bp, Homo sapiens
ttacatttgaactct

SEQ ID NO: 5759 - DNA, 15 bp, Homo sapiens
tttacatttgaactc

SEQ ID NO: 5760 - DNA, 15 bp, Homo sapiens
atttacatttgaact

SEQ ID NO: 5761 - DNA, 15 bp, Homo sapiens
tatttacatttgaac

SEQ ID NO: 5762 - DNA, 15 bp, Homo sapiens
atatttacatttgaa

SEQ ID NO: 5763 - DNA, 15 bp, Homo sapiens
aatatttacatttga

SEQ ID NO: 5764 - DNA, 15 bp, Homo sapiens
caatatttacatttg

SEQ ID NO: 5765 - DNA, 15 bp, Homo sapiens
acaatatttacattt

SEQ ID NO: 5766 - DNA, 15 bp, Homo sapiens
aacaatatttacatt

SEQ ID NO: 5767 - DNA, 15 bp, Homo sapiens
aaacaatatttacat

SEQ ID NO: 5768 - DNA, 15 bp, Homo sapiens
aaaacaatatttaca

SEQ ID NO: 5769 - DNA, 15 bp, Homo sapiens
gaaaacaatatttac

SEQ ID NO: 5770 - DNA, 15 bp, Homo sapiens
tgaaaacaatattta

SEQ ID NO: 5771 - DNA, 15 bp, Homo sapiens
atgaaaacaatattt

SEQ ID NO: 5772 - DNA, 15 bp, Homo sapiens
aatgaaaacaatatt

SEQ ID NO: 5773 - DNA, 15 bp, Homo sapiens
aaatgaaaacaatat

SEQ ID NO: 5774 - DNA, 15 bp, Homo sapiens
taaatgaaaacaata

SEQ ID NO: 5775 - DNA, 15 bp, Homo sapiens
ataaatgaaaacaat

SEQ ID NO: 5776 - DNA, 15 bp, Homo sapiens
cataaatgaaaacaa

SEQ ID NO: 5777 - DNA, 15 bp, Homo sapiens
ccataaatgaaaaca

SEQ ID NO: 5778 - DNA, 15 bp, Homo sapiens
accataaatgaaaac

SEQ ID NO: 5779 - DNA, 15 bp, Homo sapiens
gaccataaatgaaaa

SEQ ID NO: 5780 - DNA, 15 bp, Homo sapiens
ggaccataaatgaaa

SEQ ID NO: 5781 - DNA, 15 bp, Homo sapiens
aggaccataaatgaa

SEQ ID NO: 5782 - DNA, 15 bp, Homo sapiens
aaggaccataaatga

SEQ ID NO: 5783 - DNA, 15 bp, Homo sapiens
aaaggaccataaatg

SEQ ID NO: 5784 - DNA, 15 bp, Homo sapiens
aaaaggaccataaat

SEQ ID NO: 5785 - DNA, 15 bp, Homo sapiens
caaaaggaccataaa

SEQ ID NO: 5786 - DNA, 15 bp, Homo sapiens
ccaaaaggaccataa

SEQ ID NO: 5787 - DNA, 15 bp, Homo sapiens
accaaaaggaccata

SEQ ID NO: 5788 - DNA, 15 bp, Homo sapiens
aaccaaaaggaccat

SEQ ID NO: 5789 - DNA, 15 bp, Homo sapiens
taaccaaaaggacca

SEQ ID NO: 5790 - DNA, 15 bp, Homo sapiens
ataaccaaaaggacc

SEQ ID NO: 5791 - DNA, 15 bp, Homo sapiens
tataaccaaaaggac

SEQ ID NO: 5792 - DNA, 15 bp, Homo sapiens
ttataaccaaaagga

SEQ ID NO: 5793 - DNA, 15 bp, Homo sapiens
cttataaccaaaagg

SEQ ID NO: 5794 - DNA, 15 bp, Homo sapiens
acttataaccaaaag

SEQ ID NO: 5795 - DNA, 15 bp, Homo sapiens
tacttataaccaaaa

SEQ ID NO: 5796 - DNA, 15 bp, Homo sapiens
ttacttataaccaaa

SEQ ID NO: 5797 - DNA, 15 bp, Homo sapiens
gttacttataaccaa

SEQ ID NO: 5798 - DNA, 15 bp, Homo sapiens
tgttacttataacca

SEQ ID NO: 5799 - DNA, 15 bp, Homo sapiens
ctgttacttataacc

SEQ ID NO: 5800 - DNA, 15 bp, Homo sapiens
tctgttacttataac

SEQ ID NO: 5801 - DNA, 15 bp, Homo sapiens
ttctgttacttataa

SEQ ID NO: 5802 - DNA, 15 bp, Homo sapiens
tttctgttacttata

SEQ ID NO: 5803 - DNA, 15 bp, Homo sapiens
atttctgttacttat

SEQ ID NO: 5804 - DNA, 15 bp, Homo sapiens
gatttctgttactta

SEQ ID NO: 5805 - DNA, 15 bp, Homo sapiens
tgatttctgttactt

SEQ ID NO: 5806 - DNA, 15 bp, Homo sapiens
ttgatttctgttact

SEQ ID NO: 5807 - DNA, 15 bp, Homo sapiens
gttgatttctgttac

SEQ ID NO: 5808 - DNA, 15 bp, Homo sapiens
agttgatttctgtta

SEQ ID NO: 5809 - DNA, 15 bp, Homo sapiens
gagttgatttctgtt

SEQ ID NO: 5810 - DNA, 15 bp, Homo sapiens
agagttgatttctgt

SEQ ID NO: 5811 - DNA, 15 bp, Homo sapiens
tagagttgatttctg

SEQ ID NO: 5812 - DNA, 15 bp, Homo sapiens
ttagagttgatttct

SEQ ID NO: 5813 - DNA, 15 bp, Homo sapiens
tttagagttgatttc

SEQ ID NO: 5814 - DNA, 15 bp, Homo sapiens
ttttagagttgattt

SEQ ID NO: 5815 - DNA, 15 bp, Homo sapiens
tttttagagttgatt

SEQ ID NO: 5816 - DNA, 15 bp, Homo sapiens
ctttttagagttgat

SEQ ID NO: 5817 - DNA, 15 bp, Homo sapiens
tctttttagagttga

SEQ ID NO: 5818 - DNA, 15 bp, Homo sapiens
atctttttagagttg

SEQ ID NO: 5819 - DNA, 15 bp, Homo sapiens
aatctttttagagtt

SEQ ID NO: 5820 - DNA, 15 bp, Homo sapiens
aaatctttttagagt

SEQ ID NO: 5821 - DNA, 15 bp, Homo sapiens
aaaatctttttagag

SEQ ID NO: 5822 - DNA, 15 bp, Homo sapiens
aaaaatctttttaga

SEQ ID NO: 5823 - DNA, 15 bp, Homo sapiens
taaaaatctttttag

SEQ ID NO: 5824 - DNA, 15 bp, Homo sapiens
ataaaaatcttttta

SEQ ID NO: 5825 - DNA, 15 bp, Homo sapiens
aataaaaatcttttt

SEQ ID NO: 5826 - DNA, 15 bp, Homo sapiens
taataaaaatctttt

SEQ ID NO: 5827 - DNA, 15 bp, Homo sapiens
ataataaaaatcttt

SEQ ID NO: 5828 - DNA, 15 bp, Homo sapiens
tataataaaaatctt

SEQ ID NO: 5829 - DNA, 15 bp, Homo sapiens
ctataataaaaatct

SEQ ID NO: 5830 - DNA, 15 bp, Homo sapiens
cctataataaaaatc

SEQ ID NO: 5831 - DNA, 15 bp, Homo sapiens
acctataataaaaat

SEQ ID NO: 5832 - DNA, 15 bp, Homo sapiens
aacctataataaaaa

SEQ ID NO: 5833 - DNA, 15 bp, Homo sapiens
taacctataataaaa

SEQ ID NO: 5834 - DNA, 15 bp, Homo sapiens
ctaacctataataaa

SEQ ID NO: 5835 - DNA, 15 bp, Homo sapiens
tctaacctataataa

SEQ ID NO: 5836 - DNA, 15 bp, Homo sapiens
atctaacctataata

SEQ ID NO: 5837 - DNA, 15 bp, Homo sapiens
aatctaacctataat

SEQ ID NO: 5838 - DNA, 15 bp, Homo sapiens
taatctaacctataa

SEQ ID NO: 5839 - DNA, 15 bp, Homo sapiens
ataatctaacctata

SEQ ID NO: 5840 - DNA, 15 bp, Homo sapiens
cataatctaacctat

SEQ ID NO: 5841 - DNA, 15 bp, Homo sapiens
acataatctaaccta

SEQ ID NO: 5842 - DNA, 15 bp, Homo sapiens
gacataatctaacct

SEQ ID NO: 5843 - DNA, 15 bp, Homo sapiens
tgacataatctaacc

SEQ ID NO: 5844 - DNA, 15 bp, Homo sapiens
atgacataatctaac

SEQ ID NO: 5845 - DNA, 15 bp, Homo sapiens
catgacataatctaa

SEQ ID NO: 5846 - DNA, 15 bp, Homo sapiens
ccatgacataatcta

SEQ ID NO: 5847 - DNA, 15 bp, Homo sapiens
tccatgacataatct

SEQ ID NO: 5848 - DNA, 15 bp, Homo sapiens
ttccatgacataatc

SEQ ID NO: 5849 - DNA, 15 bp, Homo sapiens
gttccatgacataat

SEQ ID NO: 5850 - DNA, 15 bp, Homo sapiens
ggttccatgacataa

SEQ ID NO: 5851 - DNA, 15 bp, Homo sapiens
aggttccatgacata

SEQ ID NO: 5852 - DNA, 15 bp, Homo sapiens
aaggttccatgacat

SEQ ID NO: 5853 - DNA, 15 bp, Homo sapiens
taaggttccatgaca

SEQ ID NO: 5854 - DNA, 15 bp, Homo sapiens
ttaaggttccatgac

SEQ ID NO: 5855 - DNA, 15 bp, Homo sapiens
cttaaggttccatga

SEQ ID NO: 5856 - DNA, 15 bp, Homo sapiens
ccttaaggttccatg

SEQ ID NO: 5857 - DNA, 15 bp, Homo sapiens
gccttaaggttccat

SEQ ID NO: 5858 - DNA, 15 bp, Homo sapiens
agccttaaggttcca

SEQ ID NO: 5859 - DNA, 15 bp, Homo sapiens
aagccttaaggttcc

SEQ ID NO: 5860 - DNA, 15 bp, Homo sapiens
caagccttaaggttc

SEQ ID NO: 5861 - DNA, 15 bp, Homo sapiens
acaagccttaaggtt

SEQ ID NO: 5862 - DNA, 15 bp, Homo sapiens
gacaagccttaaggt

SEQ ID NO: 5863 - DNA, 15 bp, Homo sapiens
ggacaagccttaagg

SEQ ID NO: 5864 - DNA, 15 bp, Homo sapiens
gggacaagccttaag

SEQ ID NO: 5865 - DNA, 15 bp, Homo sapiens
agggacaagccttaa

SEQ ID NO: 5866 - DNA, 15 bp, Homo sapiens
aagggacaagcctta

SEQ ID NO: 5867 - DNA, 15 bp, Homo sapiens
aaagggacaagcctt

SEQ ID NO: 5868 - DNA, 15 bp, Homo sapiens
gaaagggacaagcct

SEQ ID NO: 5869 - DNA, 15 bp, Homo sapiens
agaaagggacaagcc

SEQ ID NO: 5870 - DNA, 15 bp, Homo sapiens
tagaaagggacaagc

SEQ ID NO: 5871 - DNA, 15 bp, Homo sapiens
ctagaaagggacaag

SEQ ID NO: 5872 - DNA, 15 bp, Homo sapiens
actagaaagggacaa

SEQ ID NO: 5873 - DNA, 15 bp, Homo sapiens
aactagaaagggaca

SEQ ID NO: 5874 - DNA, 15 bp, Homo sapiens
gaactagaaagggac

SEQ ID NO: 5875 - DNA, 15 bp, Homo sapiens
agaactagaaaggga

SEQ ID NO: 5876 - DNA, 15 bp, Homo sapiens
aagaactagaaaggg

SEQ ID NO: 5877 - DNA, 15 bp, Homo sapiens
aaagaactagaaagg

SEQ ID NO: 5878 - DNA, 15 bp, Homo sapiens
aaaagaactagaaag

SEQ ID NO: 5879 - DNA, 15 bp, Homo sapiens
caaaagaactagaaa

SEQ ID NO: 5880 - DNA, 15 bp, Homo sapiens
acaaaagaactagaa

SEQ ID NO: 5881 - DNA, 15 bp, Homo sapiens
cacaaaagaactaga

SEQ ID NO: 5882 - DNA, 15 bp, Homo sapiens
acacaaaagaactag

SEQ ID NO: 5883 - DNA, 15 bp, Homo sapiens
tacacaaaagaacta

SEQ ID NO: 5884 - DNA, 15 bp, Homo sapiens
ttacacaaaagaact

SEQ ID NO: 5885 - DNA, 15 bp, Homo sapiens
tttacacaaaagaac

SEQ ID NO: 5886 - DNA, 15 bp, Homo sapiens
ctttacacaaaagaa

SEQ ID NO: 5887 - DNA, 15 bp, Homo sapiens
gctttacacaaaaga

SEQ ID NO: 5888 - DNA, 15 bp, Homo sapiens
cgctttacacaaaag

SEQ ID NO: 5889 - DNA, 15 bp, Homo sapiens
ccgctttacacaaaa

SEQ ID NO: 5890 - DNA, 15 bp, Homo sapiens
accgctttacacaaa

SEQ ID NO: 5891 - DNA, 15 bp, Homo sapiens
caccgctttacacaa

SEQ ID NO: 5892 - DNA, 15 bp, Homo sapiens
tcaccgctttacaca

SEQ ID NO: 5893 - DNA, 15 bp, Homo sapiens
atcaccgctttacac

SEQ ID NO: 5894 - DNA, 15 bp, Homo sapiens
aatcaccgctttaca

SEQ ID NO: 5895 - DNA, 15 bp, Homo sapiens
aaatcaccgctttac

SEQ ID NO: 5896 - DNA, 15 bp, Homo sapiens
gaaatcaccgcttta

SEQ ID NO: 5897 - DNA, 15 bp, Homo sapiens
agaaatcaccgcttt

SEQ ID NO: 5898 - DNA, 15 bp, Homo sapiens
aagaaatcaccgctt

SEQ ID NO: 5899 - DNA, 15 bp, Homo sapiens
gaagaaatcaccgct

SEQ ID NO: 5900 - DNA, 15 bp, Homo sapiens
ggaagaaatcaccgc

SEQ ID NO: 5901 - DNA, 15 bp, Homo sapiens
tggaagaaatcaccg

SEQ ID NO: 5902 - DNA, 15 bp, Homo sapiens
atggaagaaatcacc

SEQ ID NO: 5903 - DNA, 15 bp, Homo sapiens
catggaagaaatcac

SEQ ID NO: 5904 - DNA, 15 bp, Homo sapiens
ccatggaagaaatca

SEQ ID NO: 5905 - DNA, 15 bp, Homo sapiens
tccatggaagaaatc

SEQ ID NO: 5906 - DNA, 15 bp, Homo sapiens
ctccatggaagaaat

SEQ ID NO: 5907 - DNA, 15 bp, Homo sapiens
cctccatggaagaaa

SEQ ID NO: 5908 - DNA, 15 bp, Homo sapiens
ccctccatggaagaa

SEQ ID NO: 5909 - DNA, 15 bp, Homo sapiens
tccctccatggaaga

SEQ ID NO: 5910 - DNA, 15 bp, Homo sapiens
ttccctccatggaag

SEQ ID NO: 5911 - DNA, 15 bp, Homo sapiens
attccctccatggaa

SEQ ID NO: 5912 - DNA, 15 bp, Homo sapiens
cattccctccatgga

SEQ ID NO: 5913 - DNA, 15 bp, Homo sapiens
ccattccctccatgg

SEQ ID NO: 5914 - DNA, 15 bp, Homo sapiens
accattccctccatg

SEQ ID NO: 5915 - DNA, 15 bp, Homo sapiens
taccattccctccat

SEQ ID NO: 5916 - DNA, 15 bp, Homo sapiens
ataccattccctcca

SEQ ID NO: 5917 - DNA, 15 bp, Homo sapiens
aataccattccctcc

SEQ ID NO: 5918 - DNA, 15 bp, Homo sapiens
aaataccattccctc

SEQ ID NO: 5919 - DNA, 15 bp, Homo sapiens
taaataccattccct

SEQ ID NO: 5920 - DNA, 15 bp, Homo sapiens
ctaaataccattccc

SEQ ID NO: 5921 - DNA, 15 bp, Homo sapiens
cctaaataccattcc

SEQ ID NO: 5922 - DNA, 15 bp, Homo sapiens
gcctaaataccattc

SEQ ID NO: 5923 - DNA, 15 bp, Homo sapiens
tgcctaaataccatt

SEQ ID NO: 5924 - DNA, 15 bp, Homo sapiens
ttgcctaaataccat

SEQ ID NO: 5925 - DNA, 15 bp, Homo sapiens
attgcctaaatacca

SEQ ID NO: 5926 - DNA, 15 bp, Homo sapiens
aattgcctaaatacc

SEQ ID NO: 5927 - DNA, 15 bp, Homo sapiens
aaattgcctaaatac

SEQ ID NO: 5928 - DNA, 15 bp, Homo sapiens
aaaattgcctaaata

SEQ ID NO: 5929 - DNA, 15 bp, Homo sapiens
aaaaattgcctaaat

SEQ ID NO: 5930 - DNA, 15 bp, Homo sapiens
aaaaaattgcctaaa

SEQ ID NO: 5931 - DNA, 15 bp, Homo sapiens
aaaaaaattgcctaa

SEQ ID NO: 5932 - DNA, 15 bp, Homo sapiens
aaaaaaaattgccta

SEQ ID NO: 5933 - DNA, 15 bp, Homo sapiens
aaaaaaaaattgcct

SEQ ID NO: 5934 - DNA, 15 bp, Homo sapiens
aaaaaaaaaattgcc

SEQ ID NO: 5935 - DNA, 15 bp, Homo sapiens
aaaaaaaaaaattgc

SEQ ID NO: 5936 - DNA, 15 bp, Homo sapiens
aaaaaaaaaaaattg

SEQ ID NO: 5937 - DNA, 15 bp, Homo sapiens
aaaaaaaaaaaaatt

SEQ ID NO: 5938 - DNA, 15 bp, Homo sapiens
cgaaaaaaaaaaaaa

SEQ ID NO: 5939 - DNA, 15 bp, Homo sapiens
tcgaaaaaaaaaaaa

SEQ ID NO: 5940 - DNA, 15 bp, Homo sapiens
ctcgaaaaaaaaaaa

SEQ ID NO: 5941 - DNA, 15 bp, Homo sapiens
tctcgaaaaaaaaaa

SEQ ID NO: 5942 - DNA, 15 bp, Homo sapiens
atctcgaaaaaaaaa

SEQ ID NO: 5943 - DNA, 15 bp, Homo sapiens
catctcgaaaaaaaa

SEQ ID NO: 5944 - DNA, 15 bp, Homo sapiens
ccatctcgaaaaaaa

SEQ ID NO: 5945 - DNA, 15 bp, Homo sapiens
tccatctcgaaaaaa

SEQ ID NO: 5946 - DNA, 15 bp, Homo sapiens
ctccatctcgaaaaa

SEQ ID NO: 5947 - DNA, 15 bp, Homo sapiens
actccatctcgaaaa

SEQ ID NO: 5948 - DNA, 15 bp, Homo sapiens
gactccatctcgaaa

SEQ ID NO: 5949 - DNA, 15 bp, Homo sapiens
agactccatctcgaa

SEQ ID NO: 5950 - DNA, 15 bp, Homo sapiens
aagactccatctcga

SEQ ID NO: 5951 - DNA, 15 bp, Homo sapiens
caagactccatctcg

SEQ ID NO: 5952 - DNA, 15 bp, Homo sapiens
agcgacagagcaaga

SEQ ID NO: 5953 - DNA, 15 bp, Homo sapiens
gagcgacagagcaag

SEQ ID NO: 5954 - DNA, 15 bp, Homo sapiens
tgagcgacagagcaa

SEQ ID NO: 5955 - DNA, 15 bp, Homo sapiens
ctgagcgacagagca

SEQ ID NO: 5956 - DNA, 15 bp, Homo sapiens
cctgagcgacagagc

SEQ ID NO: 5957 - DNA, 15 bp, Homo sapiens
gcctgagcgacagag

SEQ ID NO: 5958 - DNA, 15 bp, Homo sapiens
agcctgagcgacaga

SEQ ID NO: 5959 - DNA, 15 bp, Homo sapiens
cagcctgagcgacag

SEQ ID NO: 5960 - DNA, 15 bp, Homo sapiens
ccagcctgagcgaca

SEQ ID NO: 5961 - DNA, 15 bp, Homo sapiens
tccagcctgagcgac

SEQ ID NO: 5962 - DNA, 15 bp, Homo sapiens
ctccagcctgagcga

SEQ ID NO: 5963 - DNA, 15 bp, Homo sapiens
actccagcctgagcg

SEQ ID NO: 5964 - DNA, 15 bp, Homo sapiens
cactccagcctgagc

SEQ ID NO: 5965 - DNA, 15 bp, Homo sapiens
ggtgccactgcactc

SEQ ID NO: 5966 - DNA, 15 bp, Homo sapiens
tggtgccactgcact

SEQ ID NO: 5967 - DNA, 15 bp, Homo sapiens
atggtgccactgcac

SEQ ID NO: 5968 - DNA, 15 bp, Homo sapiens
aatggtgccactgca

SEQ ID NO: 5969 - DNA, 15 bp, Homo sapiens
aaatggtgccactgc

SEQ ID NO: 5970 - DNA, 15 bp, Homo sapiens
gaaatggtgccactg

SEQ ID NO: 5971 - DNA, 15 bp, Homo sapiens
tgaaatggtgccact

SEQ ID NO: 5972 - DNA, 15 bp, Homo sapiens
ctgaaatggtgccac

SEQ ID NO: 5973 - DNA, 15 bp, Homo sapiens
gctgaaatggtgcca

SEQ ID NO: 5974 - DNA, 15 bp, Homo sapiens
agctgaaatggtgcc

SEQ ID NO: 5975 - DNA, 15 bp, Homo sapiens
gagctgaaatggtgc

SEQ ID NO: 5976 - DNA, 15 bp, Homo sapiens
tgagctgaaatggtg

SEQ ID NO: 5977 - DNA, 15 bp, Homo sapiens
gtgagctgaaatggt

SEQ ID NO: 5978 - DNA, 15 bp, Homo sapiens
agtgagctgaaatgg

SEQ ID NO: 5979 - DNA, 15 bp, Homo sapiens
cagtgagctgaaatg

SEQ ID NO: 5980 - DNA, 15 bp, Homo sapiens
gcagtgagctgaaat

SEQ ID NO: 5981 - DNA, 15 bp, Homo sapiens
tgcagtgagctgaaa

SEQ ID NO: 5982 - DNA, 15 bp, Homo sapiens
ttgcagtgagctgaa

SEQ ID NO: 5983 - DNA, 15 bp, Homo sapiens
agttgcagtgagctg

SEQ ID NO: 5984 - DNA, 15 bp, Homo sapiens
aagttgcagtgagct

SEQ ID NO: 5985 - DNA, 15 bp, Homo sapiens
gaagttgcagtgagc

SEQ ID NO: 5986 - DNA, 15 bp, Homo sapiens
ggaagttgcagtgag

SEQ ID NO: 5987 - DNA, 15 bp, Homo sapiens
tggaagttgcagtga

SEQ ID NO: 5988 - DNA, 15 bp, Homo sapiens
gtggaagttgcagtg

SEQ ID NO: 5989 - DNA, 15 bp, Homo sapiens
ggtggaagttgcagt

SEQ ID NO: 5990 - DNA, 15 bp, Homo sapiens
aggtggaagttgcag

SEQ ID NO: 5991 - DNA, 15 bp, Homo sapiens
gaggtggaagttgca

SEQ ID NO: 5992 - DNA, 15 bp, Homo sapiens
ggaggtggaagttgc

SEQ ID NO: 5993 - DNA, 15 bp, Homo sapiens
aggaggtggaagttg

SEQ ID NO: 5994 - DNA, 15 bp, Homo sapiens
caggaggtggaagtt

SEQ ID NO: 5995 - DNA, 15 bp, Homo sapiens
ccaggaggtggaagt

SEQ ID NO: 5996 - DNA, 15 bp, Homo sapiens
cccaggaggtggaag

SEQ ID NO: 5997 - DNA, 15 bp, Homo sapiens
acccaggaggtggaa

SEQ ID NO: 5998 - DNA, 15 bp, Homo sapiens
aacccaggaggtgga

SEQ ID NO: 5999 - DNA, 15 bp, Homo sapiens
gaacccaggaggtgg

SEQ ID NO: 6000 - DNA, 15 bp, Homo sapiens
tgaacccaggaggtg

SEQ ID NO: 6001 - DNA, 15 bp, Homo sapiens
ttgaacccaggaggt

SEQ ID NO: 6002 - DNA, 15 bp, Homo sapiens
acttgaacccaggag

SEQ ID NO: 6003 - DNA, 15 bp, Homo sapiens
cacttgaacccagga

SEQ ID NO: 6004 - DNA, 15 bp, Homo sapiens
tcacttgaacccagg

SEQ ID NO: 6005 - DNA, 15 bp, Homo sapiens
atcacttgaacccag

SEQ ID NO: 6006 - DNA, 15 bp, Homo sapiens
aatcacttgaaccca

SEQ ID NO: 6007 - DNA, 15 bp, Homo sapiens
agcaggagaatcact

SEQ ID NO: 6008 - DNA, 15 bp, Homo sapiens
aagcaggagaatcac

SEQ ID NO: 6009 - DNA, 15 bp, Homo sapiens
gaagcaggagaatca

SEQ ID NO: 6010 - DNA, 15 bp, Homo sapiens
tgaagcaggagaatc

SEQ ID NO: 6011 - DNA, 15 bp, Homo sapiens
ctgaagcaggagaat

SEQ ID NO: 6012 - DNA, 15 bp, Homo sapiens
gctgaagcaggagaa

SEQ ID NO: 6013 - DNA, 15 bp, Homo sapiens
ggctgaagcaggaga

SEQ ID NO: 6014 - DNA, 15 bp, Homo sapiens
aggctgaagcaggag

SEQ ID NO: 6015 - DNA, 15 bp, Homo sapiens
gaggctgaagcagga

SEQ ID NO: 6016 - DNA, 15 bp, Homo sapiens
ggaggctgaagcagg

SEQ ID NO: 6017 - DNA, 15 bp, Homo sapiens
gggaggctgaagcag

SEQ ID NO: 6018 - DNA, 15 bp, Homo sapiens
tgggaggctgaagca

SEQ ID NO: 6019 - DNA, 15 bp, Homo sapiens
ttgggaggctgaagc

SEQ ID NO: 6020 - DNA, 15 bp, Homo sapiens
cttgggaggctgaag

SEQ ID NO: 6021 - DNA, 15 bp, Homo sapiens
acttgggaggctgaa

SEQ ID NO: 6022 - DNA, 15 bp, Homo sapiens
tcagctacttgggag

SEQ ID NO: 6023 - DNA, 15 bp, Homo sapiens
ctcagctacttggga

SEQ ID NO: 6024 - DNA, 15 bp, Homo sapiens
tctcagctacttggg

SEQ ID NO: 6025 - DNA, 15 bp, Homo sapiens
atctcagctacttgg

SEQ ID NO: 6026 - DNA, 15 bp, Homo sapiens
aatctcagctacttg

SEQ ID NO: 6027 - DNA, 15 bp, Homo sapiens
taatctcagctactt

SEQ ID NO: 6028 - DNA, 15 bp, Homo sapiens
gtgcctgtaatctca

SEQ ID NO: 6029 - DNA, 15 bp, Homo sapiens
ggtgcctgtaatctc

SEQ ID NO: 6030 - DNA, 15 bp, Homo sapiens
gggtgcctgtaatct

SEQ ID NO: 6031 - DNA, 15 bp, Homo sapiens
cgggtgcctgtaatc

SEQ ID NO: 6032 - DNA, 15 bp, Homo sapiens
gcgggtgcctgtaat

SEQ ID NO: 6033 - DNA, 15 bp, Homo sapiens
ggcgggtgcctgtaa

SEQ ID NO: 6034 - DNA, 15 bp, Homo sapiens
tggcgggtgcctgta

SEQ ID NO: 6035 - DNA, 15 bp, Homo sapiens
gtggcgggtgcctgt

SEQ ID NO: 6036 - DNA, 15 bp, Homo sapiens
ggtggcgggtgcctg

SEQ ID NO: 6037 - DNA, 15 bp, Homo sapiens
tggtggcgggtgcct

SEQ ID NO: 6038 - DNA, 15 bp, Homo sapiens
gtggtggcgggtgcc

SEQ ID NO: 6039 - DNA, 15 bp, Homo sapiens
tgtggtggcgggtgc

SEQ ID NO: 6040 - DNA, 15 bp, Homo sapiens
gtgtggtggcgggtg

SEQ ID NO: 6041 - DNA, 15 bp, Homo sapiens
ggtgtggtggcgggt

SEQ ID NO: 6042 - DNA, 15 bp, Homo sapiens
gggtgtggtggcggg

SEQ ID NO: 6043 - DNA, 15 bp, Homo sapiens
cgggtgtggtggcgg

SEQ ID NO: 6044 - DNA, 15 bp, Homo sapiens
ccgggtgtggtggcg

SEQ ID NO: 6045 - DNA, 15 bp, Homo sapiens
gccgggtgtggtggc

SEQ ID NO: 6046 - DNA, 15 bp, Homo sapiens
aagccgggtgtggtg

SEQ ID NO: 6047 - DNA, 15 bp, Homo sapiens
taagccgggtgtggt

SEQ ID NO: 6048 - DNA, 15 bp, Homo sapiens
ataagccgggtgtgg

SEQ ID NO: 6049 - DNA, 15 bp, Homo sapiens
aataagccgggtgtg

SEQ ID NO: 6050 - DNA, 15 bp, Homo sapiens
aaataagccgggtgt

SEQ ID NO: 6051 - DNA, 15 bp, Homo sapiens
aaaataagccgggtg

SEQ ID NO: 6052 - DNA, 15 bp, Homo sapiens
caaaataagccgggt

SEQ ID NO: 6053 - DNA, 15 bp, Homo sapiens
acaaaataagccggg

SEQ ID NO: 6054 - DNA, 15 bp, Homo sapiens
tacaaaataagccgg

SEQ ID NO: 6055 - DNA, 15 bp, Homo sapiens
atacaaaataagccg

SEQ ID NO: 6056 - DNA, 15 bp, Homo sapiens
aatacaaaataagcc

SEQ ID NO: 6057 - DNA, 15 bp, Homo sapiens
aaatacaaaataagc

SEQ ID NO: 6058 - DNA, 15 bp, Homo sapiens
aaaatacaaaataag

SEQ ID NO: 6059 - DNA, 15 bp, Homo sapiens
aaaaatacaaaataa

SEQ ID NO: 6060 - DNA, 15 bp, Homo sapiens
taaaaatacaaaata

SEQ ID NO: 6061 - DNA, 15 bp, Homo sapiens
agatcacttgaggtc

SEQ ID NO: 6062 - DNA, 15 bp, Homo sapiens
gagatcacttgaggt

SEQ ID NO: 6063 - DNA, 15 bp, Homo sapiens
ggagatcacttgagg

SEQ ID NO: 6064 - DNA, 15 bp, Homo sapiens
gggagatcacttgag

SEQ ID NO: 6065 - DNA, 15 bp, Homo sapiens
ggggagatcacttga

SEQ ID NO: 6066 - DNA, 15 bp, Homo sapiens
tggggagatcacttg

SEQ ID NO: 6067 - DNA, 15 bp, Homo sapiens
gtggggagatcactt

SEQ ID NO: 6068 - DNA, 15 bp, Homo sapiens
ggtggggagatcact

SEQ ID NO: 6069 - DNA, 15 bp, Homo sapiens
aggtggggagatcac

SEQ ID NO: 6070 - DNA, 15 bp, Homo sapiens
aaggtggggagatca

SEQ ID NO: 6071 - DNA, 15 bp, Homo sapiens
caaggtggggagatc

SEQ ID NO: 6072 - DNA, 15 bp, Homo sapiens
ccaaggtggggagat

SEQ ID NO: 6073 - DNA, 15 bp, Homo sapiens
gccaaggtggggaga

SEQ ID NO: 6074 - DNA, 15 bp, Homo sapiens
ggccaaggtggggag

SEQ ID NO: 6075 - DNA, 15 bp, Homo sapiens
aggccaaggtgggga

SEQ ID NO: 6076 - DNA, 15 bp, Homo sapiens
aaggccaaggtgggg

SEQ ID NO: 6077 - DNA, 15 bp, Homo sapiens
gaaggccaaggtggg

SEQ ID NO: 6078 - DNA, 15 bp, Homo sapiens
ggaaggccaaggtgg

SEQ ID NO: 6079 - DNA, 15 bp, Homo sapiens
tggaaggccaaggtg

SEQ ID NO: 6080 - DNA, 15 bp, Homo sapiens
ttggaaggccaaggt

SEQ ID NO: 6081 - DNA, 15 bp, Homo sapiens
tttggaaggccaagg

SEQ ID NO: 6082 - DNA, 15 bp, Homo sapiens
ctttggaaggccaag

SEQ ID NO: 6083 - DNA, 15 bp, Homo sapiens
actttggaaggccaa

SEQ ID NO: 6084 - DNA, 15 bp, Homo sapiens
cactttggaaggcca

SEQ ID NO: 6085 - DNA, 15 bp, Homo sapiens
gcactttggaaggcc

SEQ ID NO: 6086 - DNA, 15 bp, Homo sapiens
agcactttggaaggc

SEQ ID NO: 6087 - DNA, 15 bp, Homo sapiens
tagcactttggaagg

SEQ ID NO: 6088 - DNA, 15 bp, Homo sapiens
ctagcactttggaag

SEQ ID NO: 6089 - DNA, 15 bp, Homo sapiens
cctagcactttggaa

SEQ ID NO: 6090 - DNA, 15 bp, Homo sapiens
tcctagcactttgga

SEQ ID NO: 6091 - DNA, 15 bp, Homo sapiens
cgcctgtaatcctag

SEQ ID NO: 6092 - DNA, 15 bp, Homo sapiens
gcgcctgtaatccta

SEQ ID NO: 6093 - DNA, 15 bp, Homo sapiens
ggcgcctgtaatcct

SEQ ID NO: 6094 - DNA, 15 bp, Homo sapiens
taggcgcctgtaatc

SEQ ID NO: 6095 - DNA, 15 bp, Homo sapiens
ctaggcgcctgtaat

SEQ ID NO: 6096 - DNA, 15 bp, Homo sapiens
gctaggcgcctgtaa

SEQ ID NO: 6097 - DNA, 15 bp, Homo sapiens
ggctaggcgcctgta

SEQ ID NO: 6098 - DNA, 15 bp, Homo sapiens
aggctaggcgcctgt

SEQ ID NO: 6099 - DNA, 15 bp, Homo sapiens
taggctaggcgcctg

SEQ ID NO: 6100 - DNA, 15 bp, Homo sapiens
ctaggctaggcgcct

SEQ ID NO: 6101 - DNA, 15 bp, Homo sapiens
cctaggctaggcgcc

SEQ ID NO: 6102 - DNA, 15 bp, Homo sapiens
gcctaggctaggcgc

SEQ ID NO: 6103 - DNA, 15 bp, Homo sapiens
tgcctaggctaggcg

SEQ ID NO: 6104 - DNA, 15 bp, Homo sapiens
ctgcctaggctaggc

SEQ ID NO: 6105 - DNA, 15 bp, Homo sapiens
actgcctaggctagg

SEQ ID NO: 6106 - DNA, 15 bp, Homo sapiens
gactgcctaggctag

SEQ ID NO: 6107 - DNA, 15 bp, Homo sapiens
tgactgcctaggcta

SEQ ID NO: 6108 - DNA, 15 bp, Homo sapiens
atgactgcctaggct

SEQ ID NO: 6109 - DNA, 15 bp, Homo sapiens
aatgactgcctaggc

SEQ ID NO: 6110 - DNA, 15 bp, Homo sapiens
aaatgactgcctagg

SEQ ID NO: 6111 - DNA, 15 bp, Homo sapiens
aaaatgactgcctag

SEQ ID NO: 6112 - DNA, 15 bp, Homo sapiens
gaaaatgactgccta

SEQ ID NO: 6113 - DNA, 15 bp, Homo sapiens
tgaaaatgactgcct

SEQ ID NO: 6114 - DNA, 15 bp, Homo sapiens
ttgaaaatgactgcc

SEQ ID NO: 6115 - DNA, 15 bp, Homo sapiens
tttgaaaatgactgc

SEQ ID NO: 6116 - DNA, 15 bp, Homo sapiens
ttttgaaaatgactg

SEQ ID NO: 6117 - DNA, 15 bp, Homo sapiens
tttttgaaaatgact

SEQ ID NO: 6118 - DNA, 15 bp, Homo sapiens
ttttttgaaaatgac

SEQ ID NO: 6119 - DNA, 15 bp, Homo sapiens
gttttttgaaaatga

SEQ ID NO: 6120 - DNA, 15 bp, Homo sapiens
tgttttttgaaaatg

SEQ ID NO: 6121 - DNA, 15 bp, Homo sapiens
ttgttttttgaaaat

SEQ ID NO: 6122 - DNA, 15 bp, Homo sapiens
cttgttttttgaaaa

SEQ ID NO: 6123 - DNA, 15 bp, Homo sapiens
gcttgttttttgaaa

SEQ ID NO: 6124 - DNA, 15 bp, Homo sapiens
tgcttgttttttgaa

SEQ ID NO: 6125 - DNA, 15 bp, Homo sapiens
atgcttgttttttga

SEQ ID NO: 6126 - DNA, 15 bp, Homo sapiens
catgcttgttttttg

SEQ ID NO: 6127 - DNA, 15 bp, Homo sapiens
tcatgcttgtttttt

SEQ ID NO: 6128 - DNA, 15 bp, Homo sapiens
gtcatgcttgttttt

SEQ ID NO: 6129 - DNA, 15 bp, Homo sapiens
agtcatgcttgtttt

SEQ ID NO: 6130 - DNA, 15 bp, Homo sapiens
gagtcatgcttgttt

SEQ ID NO: 6131 - DNA, 15 bp, Homo sapiens
tgagtcatgcttgtt

SEQ ID NO: 6132 - DNA, 15 bp, Homo sapiens
gtgagtcatgcttgt

SEQ ID NO: 6133 - DNA, 15 bp, Homo sapiens
ggtgagtcatgcttg

SEQ ID NO: 6134 - DNA, 15 bp, Homo sapiens
tggtgagtcatgctt

SEQ ID NO: 6135 - DNA, 15 bp, Homo sapiens
ttggtgagtcatgct

SEQ ID NO: 6136 - DNA, 15 bp, Homo sapiens
tttggtgagtcatgc

SEQ ID NO: 6137 - DNA, 15 bp, Homo sapiens
ttttggtgagtcatg

SEQ ID NO: 6138 - DNA, 15 bp, Homo sapiens
cttttggtgagtcat

SEQ ID NO: 6139 - DNA, 15 bp, Homo sapiens
acttttggtgagtca

SEQ ID NO: 6140 - DNA, 15 bp, Homo sapiens
aacttttggtgagtc

SEQ ID NO: 6141 - DNA, 15 bp, Homo sapiens
aaacttttggtgagt

SEQ ID NO: 6142 - DNA, 15 bp, Homo sapiens
aaaacttttggtgag

SEQ ID NO: 6143 - DNA, 15 bp, Homo sapiens
taaaacttttggtga

SEQ ID NO: 6144 - DNA, 15 bp, Homo sapiens
ttaaaacttttggtg

SEQ ID NO: 6145 - DNA, 15 bp, Homo sapiens
cttaaaacttttggt

SEQ ID NO: 6146 - DNA, 15 bp, Homo sapiens
tcttaaaacttttgg

SEQ ID NO: 6147 - DNA, 15 bp, Homo sapiens
atcttaaaacttttg

SEQ ID NO: 6148 - DNA, 15 bp, Homo sapiens
aatcttaaaactttt

SEQ ID NO: 6149 - DNA, 15 bp, Homo sapiens
aaatcttaaaacttt

SEQ ID NO: 6150 - DNA, 15 bp, Homo sapiens
aaaatcttaaaactt

SEQ ID NO: 6151 - DNA, 15 bp, Homo sapiens
gaaaatcttaaaact

SEQ ID NO: 6152 - DNA, 15 bp, Homo sapiens
agaaaatcttaaaac

SEQ ID NO: 6153 - DNA, 15 bp, Homo sapiens
cagaaaatcttaaaa

SEQ ID NO: 6154 - DNA, 15 bp, Homo sapiens
acagaaaatcttaaa

SEQ ID NO: 6155 - DNA, 15 bp, Homo sapiens
cacagaaaatcttaa

SEQ ID NO: 6156 - DNA, 15 bp, Homo sapiens
tcacagaaaatctta

SEQ ID NO: 6157 - DNA, 15 bp, Homo sapiens
atcacagaaaatctt

SEQ ID NO: 6158 - DNA, 15 bp, Homo sapiens
tatcacagaaaatct

SEQ ID NO: 6159 - DNA, 15 bp, Homo sapiens
ttatcacagaaaatc

SEQ ID NO: 6160 - DNA, 15 bp, Homo sapiens
attatcacagaaaat

SEQ ID NO: 6161 - DNA, 15 bp, Homo sapiens
cattatcacagaaaa

SEQ ID NO: 6162 - DNA, 15 bp, Homo sapiens
acattatcacagaaa

SEQ ID NO: 6163 - DNA, 15 bp, Homo sapiens
aacattatcacagaa

SEQ ID NO: 6164 - DNA, 15 bp, Homo sapiens
gaacattatcacaga

SEQ ID NO: 6165 - DNA, 15 bp, Homo sapiens
agaacattatcacag

SEQ ID NO: 6166 - DNA, 15 bp, Homo sapiens
aagaacattatcaca

SEQ ID NO: 6167 - DNA, 15 bp, Homo sapiens
taagaacattatcac

SEQ ID NO: 6168 - DNA, 15 bp, Homo sapiens
ataagaacattatca

SEQ ID NO: 6169 - DNA, 15 bp, Homo sapiens
aataagaacattatc

SEQ ID NO: 6170 - DNA, 15 bp, Homo sapiens
caataagaacattat

SEQ ID NO: 6171 - DNA, 15 bp, Homo sapiens
tcaataagaacatta

SEQ ID NO: 6172 - DNA, 15 bp, Homo sapiens
ctcaataagaacatt

SEQ ID NO: 6173 - DNA, 15 bp, Homo sapiens
cctcaataagaacat

SEQ ID NO: 6174 - DNA, 15 bp, Homo sapiens
gcctcaataagaaca

SEQ ID NO: 6175 - DNA, 15 bp, Homo sapiens
agcctcaataagaac

SEQ ID NO: 6176 - DNA, 15 bp, Homo sapiens
aagcctcaataagaa

SEQ ID NO: 6177 - DNA, 15 bp, Homo sapiens
taagcctcaataaga

SEQ ID NO: 6178 - DNA, 15 bp, Homo sapiens
gtaagcctcaataag

SEQ ID NO: 6179 - DNA, 15 bp, Homo sapiens
tgtaagcctcaataa

SEQ ID NO: 6180 - DNA, 15 bp, Homo sapiens
atgtaagcctcaata

SEQ ID NO: 6181 - DNA, 15 bp, Homo sapiens
aatgtaagcctcaat

SEQ ID NO: 6182 - DNA, 15 bp, Homo sapiens
taatgtaagcctcaa

SEQ ID NO: 6183 - DNA, 15 bp, Homo sapiens
ataatgtaagcctca

SEQ ID NO: 6184 - DNA, 15 bp, Homo sapiens
tataatgtaagcctc

SEQ ID NO: 6185 - DNA, 15 bp, Homo sapiens
atataatgtaagcct

SEQ ID NO: 6186 - DNA, 15 bp, Homo sapiens
aatataatgtaagcc

SEQ ID NO: 6187 - DNA, 15 bp, Homo sapiens
taatataatgtaagc

SEQ ID NO: 6188 - DNA, 15 bp, Homo sapiens
gtaatataatgtaag

SEQ ID NO: 6189 - DNA, 15 bp, Homo sapiens
tgtaatataatgtaa

SEQ ID NO: 6190 - DNA, 15 bp, Homo sapiens
ctgtaatataatgta

SEQ ID NO: 6191 - DNA, 15 bp, Homo sapiens
actgtaatataatgt

SEQ ID NO: 6192 - DNA, 15 bp, Homo sapiens
aactgtaatataatg

SEQ ID NO: 6193 - DNA, 15 bp, Homo sapiens
aaactgtaatataat

SEQ ID NO: 6194 - DNA, 15 bp, Homo sapiens
gaaactgtaatataa

SEQ ID NO: 6195 - DNA, 15 bp, Homo sapiens
agaaactgtaatata

SEQ ID NO: 6196 - DNA, 15 bp, Homo sapiens
aagaaactgtaatat

SEQ ID NO: 6197 - DNA, 15 bp, Homo sapiens
caagaaactgtaata

SEQ ID NO: 6198 - DNA, 15 bp, Homo sapiens
tcaagaaactgtaat

SEQ ID NO: 6199 - DNA, 15 bp, Homo sapiens
ttcaagaaactgtaa

SEQ ID NO: 6200 - DNA, 15 bp, Homo sapiens
attcaagaaactgta

SEQ ID NO: 6201 - DNA, 15 bp, Homo sapiens
gattcaagaaactgt

SEQ ID NO: 6202 - DNA, 15 bp, Homo sapiens
agattcaagaaactg

SEQ ID NO: 6203 - DNA, 15 bp, Homo sapiens
tagattcaagaaact

SEQ ID NO: 6204 - DNA, 15 bp, Homo sapiens
ttagattcaagaaac

SEQ ID NO: 6205 - DNA, 15 bp, Homo sapiens
tttagattcaagaaa

SEQ ID NO: 6206 - DNA, 15 bp, Homo sapiens
ttttagattcaagaa

SEQ ID NO: 6207 - DNA, 15 bp, Homo sapiens
attttagattcaaga

SEQ ID NO: 6208 - DNA, 15 bp, Homo sapiens
cattttagattcaag

SEQ ID NO: 6209 - DNA, 15 bp, Homo sapiens
tcattttagattcaa

SEQ ID NO: 6210 - DNA, 15 bp, Homo sapiens
atcattttagattca

SEQ ID NO: 6211 - DNA, 15 bp, Homo sapiens
catcattttagattc

SEQ ID NO: 6212 - DNA, 15 bp, Homo sapiens
acatcattttagatt

SEQ ID NO: 6213 - DNA, 15 bp, Homo sapiens
tacatcattttagat

SEQ ID NO: 6214 - DNA, 15 bp, Homo sapiens
gtacatcattttaga

SEQ ID NO: 6215 - DNA, 15 bp, Homo sapiens
ggtacatcattttag

SEQ ID NO: 6216 - DNA, 15 bp, Homo sapiens
gggtacatcatttta

SEQ ID NO: 6217 - DNA, 15 bp, Homo sapiens
agggtacatcatttt

SEQ ID NO: 6218 - DNA, 15 bp, Homo sapiens
gagggtacatcattt

SEQ ID NO: 6219 - DNA, 15 bp, Homo sapiens
agagggtacatcatt

SEQ ID NO: 6220 - DNA, 15 bp, Homo sapiens
aagagggtacatcat

SEQ ID NO: 6221 - DNA, 15 bp, Homo sapiens
taagagggtacatca

SEQ ID NO: 6222 - DNA, 15 bp, Homo sapiens
ctaagagggtacatc

SEQ ID NO: 6223 - DNA, 15 bp, Homo sapiens
cctaagagggtacat

SEQ ID NO: 6224 - DNA, 15 bp, Homo sapiens
tcctaagagggtaca

SEQ ID NO: 6225 - DNA, 15 bp, Homo sapiens
atcctaagagggtac

SEQ ID NO: 6226 - DNA, 15 bp, Homo sapiens
tatcctaagagggta

SEQ ID NO: 6227 - DNA, 15 bp, Homo sapiens
atatcctaagagggt

SEQ ID NO: 6228 - DNA, 15 bp, Homo sapiens
tatatcctaagaggg

SEQ ID NO: 6229 - DNA, 15 bp, Homo sapiens
atatatcctaagagg

SEQ ID NO: 6230 - DNA, 15 bp, Homo sapiens
tatatatcctaagag

SEQ ID NO: 6231 - DNA, 15 bp, Homo sapiens
gtatatatcctaaga

SEQ ID NO: 6232 - DNA, 15 bp, Homo sapiens
tgtatatatcctaag

SEQ ID NO: 6233 - DNA, 15 bp, Homo sapiens
atgtatatatcctaa

SEQ ID NO: 6234 - DNA, 15 bp, Homo sapiens
gatgtatatatccta

SEQ ID NO: 6235 - DNA, 15 bp, Homo sapiens
tgatgtatatatcct

SEQ ID NO: 6236 - DNA, 15 bp, Homo sapiens
atgatgtatatatcc

SEQ ID NO: 6237 - DNA, 15 bp, Homo sapiens
catgatgtatatatc

SEQ ID NO: 6238 - DNA, 15 bp, Homo sapiens
gcatgatgtatatat

SEQ ID NO: 6239 - DNA, 15 bp, Homo sapiens
agcatgatgtatata

SEQ ID NO: 6240 - DNA, 15 bp, Homo sapiens
aagcatgatgtatat

SEQ ID NO: 6241 - DNA, 15 bp, Homo sapiens
gaagcatgatgtata

SEQ ID NO: 6242 - DNA, 15 bp, Homo sapiens
tgaagcatgatgtat

SEQ ID NO: 6243 - DNA, 15 bp, Homo sapiens
atgaagcatgatgta

SEQ ID NO: 6244 - DNA, 15 bp, Homo sapiens
aatgaagcatgatgt

SEQ ID NO: 6245 - DNA, 15 bp, Homo sapiens
caatgaagcatgatg

SEQ ID NO: 6246 - DNA, 15 bp, Homo sapiens
ccaatgaagcatgat

SEQ ID NO: 6247 - DNA, 15 bp, Homo sapiens
accaatgaagcatga

SEQ ID NO: 6248 - DNA, 15 bp, Homo sapiens
gaccaatgaagcatg

SEQ ID NO: 6249 - DNA, 15 bp, Homo sapiens
agaccaatgaagcat

SEQ ID NO: 6250 - DNA, 15 bp, Homo sapiens
gagaccaatgaagca

SEQ ID NO: 6251 - DNA, 15 bp, Homo sapiens
tgagaccaatgaagc

SEQ ID NO: 6252 - DNA, 15 bp, Homo sapiens
ctgagaccaatgaag

SEQ ID NO: 6253 - DNA, 15 bp, Homo sapiens
cctgagaccaatgaa

SEQ ID NO: 6254 - DNA, 15 bp, Homo sapiens
ccctgagaccaatga

SEQ ID NO: 6255 - DNA, 15 bp, Homo sapiens
cccctgagaccaatg

SEQ ID NO: 6256 - DNA, 15 bp, Homo sapiens
ccccctgagaccaat

SEQ ID NO: 6257 - DNA, 15 bp, Homo sapiens
gccccctgagaccaa

SEQ ID NO: 6258 - DNA, 15 bp, Homo sapiens
agccccctgagacca

SEQ ID NO: 6259 - DNA, 15 bp, Homo sapiens
cagccccctgagacc

SEQ ID NO: 6260 - DNA, 15 bp, Homo sapiens
tcagccccctgagac

SEQ ID NO: 6261 - DNA, 15 bp, Homo sapiens
atcagccccctgaga

SEQ ID NO: 6262 - DNA, 15 bp, Homo sapiens
aatcagccccctgag

SEQ ID NO: 6263 - DNA, 15 bp, Homo sapiens
aaatcagccccctga

SEQ ID NO: 6264 - DNA, 15 bp, Homo sapiens
aaaatcagccccctg

SEQ ID NO: 6265 - DNA, 15 bp, Homo sapiens
aaaaatcagccccct

SEQ ID NO: 6266 - DNA, 15 bp, Homo sapiens
taaaaatcagccccc

SEQ ID NO: 6267 - DNA, 15 bp, Homo sapiens
ataaaaatcagcccc

SEQ ID NO: 6268 - DNA, 15 bp, Homo sapiens
tataaaaatcagccc

SEQ ID NO: 6269 - DNA, 15 bp, Homo sapiens
ttataaaaatcagcc

SEQ ID NO: 6270 - DNA, 15 bp, Homo sapiens
cttataaaaatcagc

SEQ ID NO: 6271 - DNA, 15 bp, Homo sapiens
ccttataaaaatcag

SEQ ID NO: 6272 - DNA, 15 bp, Homo sapiens
tccttataaaaatca

SEQ ID NO: 6273 - DNA, 15 bp, Homo sapiens
ctccttataaaaatc

SEQ ID NO: 6274 - DNA, 15 bp, Homo sapiens
tctccttataaaaat

SEQ ID NO: 6275 - DNA, 15 bp, Homo sapiens
ctctccttataaaaa

SEQ ID NO: 6276 - DNA, 15 bp, Homo sapiens
tctctccttataaaa

SEQ ID NO: 6277 - DNA, 15 bp, Homo sapiens
atctctccttataaa

SEQ ID NO: 6278 - DNA, 15 bp, Homo sapiens
aatctctccttataa

SEQ ID NO: 6279 - DNA, 15 bp, Homo sapiens
aaatctctccttata

SEQ ID NO: 6280 - DNA, 15 bp, Homo sapiens
caaatctctccttat

SEQ ID NO: 6281 - DNA, 15 bp, Homo sapiens
gcaaatctctcctta

SEQ ID NO: 6282 - DNA, 15 bp, Homo sapiens
agcaaatctctcctt

SEQ ID NO: 6283 - DNA, 15 bp, Homo sapiens
tagcaaatctctcct

SEQ ID NO: 6284 - DNA, 15 bp, Homo sapiens
ctagcaaatctctcc

SEQ ID NO: 6285 - DNA, 15 bp, Homo sapiens
actagcaaatctctc

SEQ ID NO: 6286 - DNA, 15 bp, Homo sapiens
aactagcaaatctct

SEQ ID NO: 6287 - DNA, 15 bp, Homo sapiens
aaactagcaaatctc

SEQ ID NO: 6288 - DNA, 15 bp, Homo sapiens
aaaactagcaaatct

SEQ ID NO: 6289 - DNA, 15 bp, Homo sapiens
gaaaactagcaaatc

SEQ ID NO: 6290 - DNA, 15 bp, Homo sapiens
tgaaaactagcaaat

SEQ ID NO: 6291 - DNA, 15 bp, Homo sapiens
gtgaaaactagcaaa

SEQ ID NO: 6292 - DNA, 15 bp, Homo sapiens
tgtgaaaactagcaa

SEQ ID NO: 6293 - DNA, 15 bp, Homo sapiens
ttgtgaaaactagca

SEQ ID NO: 6294 - DNA, 15 bp, Homo sapiens
attgtgaaaactagc

SEQ ID NO: 6295 - DNA, 15 bp, Homo sapiens
tattgtgaaaactag

SEQ ID NO: 6296 - DNA, 15 bp, Homo sapiens
atattgtgaaaacta

SEQ ID NO: 6297 - DNA, 15 bp, Homo sapiens
catattgtgaaaact

SEQ ID NO: 6298 - DNA, 15 bp, Homo sapiens
acatattgtgaaaac

SEQ ID NO: 6299 - DNA, 15 bp, Homo sapiens
gacatattgtgaaaa

SEQ ID NO: 6300 - DNA, 15 bp, Homo sapiens
ggacatattgtgaaa

SEQ ID NO: 6301 - DNA, 15 bp, Homo sapiens
aggacatattgtgaa

SEQ ID NO: 6302 - DNA, 15 bp, Homo sapiens
gaggacatattgtga

SEQ ID NO: 6303 - DNA, 15 bp, Homo sapiens
agaggacatattgtg

SEQ ID NO: 6304 - DNA, 15 bp, Homo sapiens
tagaggacatattgt

SEQ ID NO: 6305 - DNA, 15 bp, Homo sapiens
ttagaggacatattg

SEQ ID NO: 6306 - DNA, 15 bp, Homo sapiens
cttagaggacatatt

SEQ ID NO: 6307 - DNA, 15 bp, Homo sapiens
acttagaggacatat

SEQ ID NO: 6308 - DNA, 15 bp, Homo sapiens
aacttagaggacata

SEQ ID NO: 6309 - DNA, 15 bp, Homo sapiens
caacttagaggacat

SEQ ID NO: 6310 - DNA, 15 bp, Homo sapiens
ccaacttagaggaca

SEQ ID NO: 6311 - DNA, 15 bp, Homo sapiens
gccaacttagaggac

SEQ ID NO: 6312 - DNA, 15 bp, Homo sapiens
tgccaacttagagga

SEQ ID NO: 6313 - DNA, 15 bp, Homo sapiens
atgccaacttagagg

SEQ ID NO: 6314 - DNA, 15 bp, Homo sapiens
catgccaacttagag

SEQ ID NO: 6315 - DNA, 15 bp, Homo sapiens
acatgccaacttaga

SEQ ID NO: 6316 - DNA, 15 bp, Homo sapiens
tacatgccaacttag

SEQ ID NO: 6317 - DNA, 15 bp, Homo sapiens
atacatgccaactta

SEQ ID NO: 6318 - DNA, 15 bp, Homo sapiens
tatacatgccaactt

SEQ ID NO: 6319 - DNA, 15 bp, Homo sapiens
ctatacatgccaact

SEQ ID NO: 6320 - DNA, 15 bp, Homo sapiens
gctatacatgccaac

SEQ ID NO: 6321 - DNA, 15 bp, Homo sapiens
agctatacatgccaa

SEQ ID NO: 6322 - DNA, 15 bp, Homo sapiens
tagctatacatgcca

SEQ ID NO: 6323 - DNA, 15 bp, Homo sapiens
ttagctatacatgcc

SEQ ID NO: 6324 - DNA, 15 bp, Homo sapiens
tttagctatacatgc

SEQ ID NO: 6325 - DNA, 15 bp, Homo sapiens
gtttagctatacatg

SEQ ID NO: 6326 - DNA, 15 bp, Homo sapiens
tgtttagctatacat

SEQ ID NO: 6327 - DNA, 15 bp, Homo sapiens
ctgtttagctataca

SEQ ID NO: 6328 - DNA, 15 bp, Homo sapiens
cctgtttagctatac

SEQ ID NO: 6329 - DNA, 15 bp, Homo sapiens
gcctgtttagctata

SEQ ID NO: 6330 - DNA, 15 bp, Homo sapiens
agcctgtttagctat

SEQ ID NO: 6331 - DNA, 15 bp, Homo sapiens
aagcctgtttagcta

SEQ ID NO: 6332 - DNA, 15 bp, Homo sapiens
aaagcctgtttagct

SEQ ID NO: 6333 - DNA, 15 bp, Homo sapiens
gaaagcctgtttagc

SEQ ID NO: 6334 - DNA, 15 bp, Homo sapiens
tgaaagcctgtttag

SEQ ID NO: 6335 - DNA, 15 bp, Homo sapiens
atgaaagcctgttta

SEQ ID NO: 6336 - DNA, 15 bp, Homo sapiens
tatgaaagcctgttt

SEQ ID NO: 6337 - DNA, 15 bp, Homo sapiens
ttatgaaagcctgtt

SEQ ID NO: 6338 - DNA, 15 bp, Homo sapiens
tttatgaaagcctgt

SEQ ID NO: 6339 - DNA, 15 bp, Homo sapiens
ttttatgaaagcctg

SEQ ID NO: 6340 - DNA, 15 bp, Homo sapiens
tttttatgaaagcct

SEQ ID NO: 6341 - DNA, 15 bp, Homo sapiens
atttttatgaaagcc

SEQ ID NO: 6342 - DNA, 15 bp, Homo sapiens
tatttttatgaaagc

SEQ ID NO: 6343 - DNA, 15 bp, Homo sapiens
atatttttatgaaag

SEQ ID NO: 6344 - DNA, 15 bp, Homo sapiens
tatatttttatgaaa

SEQ ID NO: 6345 - DNA, 15 bp, Homo sapiens
gtatatttttatgaa

SEQ ID NO: 6346 - DNA, 15 bp, Homo sapiens
tgtatatttttatga

SEQ ID NO: 6347 - DNA, 15 bp, Homo sapiens
ttgtatatttttatg

SEQ ID NO: 6348 - DNA, 15 bp, Homo sapiens
attgtatatttttat

SEQ ID NO: 6349 - DNA, 15 bp, Homo sapiens
aattgtatattttta

SEQ ID NO: 6350 - DNA, 15 bp, Homo sapiens
aaattgtatattttt

SEQ ID NO: 6351 - DNA, 15 bp, Homo sapiens
taaattgtatatttt

SEQ ID NO: 6352 - DNA, 15 bp, Homo sapiens
ctaaattgtatattt

SEQ ID NO: 6353 - DNA, 15 bp, Homo sapiens
actaaattgtatatt

SEQ ID NO: 6354 - DNA, 15 bp, Homo sapiens
aactaaattgtatat

SEQ ID NO: 6355 - DNA, 15 bp, Homo sapiens
taactaaattgtata

SEQ ID NO: 6356 - DNA, 15 bp, Homo sapiens
ttaactaaattgtat

SEQ ID NO: 6357 - DNA, 15 bp, Homo sapiens
attaactaaattgta

SEQ ID NO: 6358 - DNA, 15 bp, Homo sapiens
cattaactaaattgt

SEQ ID NO: 6359 - DNA, 15 bp, Homo sapiens
tcattaactaaattg

SEQ ID NO: 6360 - DNA, 15 bp, Homo sapiens
ttcattaactaaatt

SEQ ID NO: 6361 - DNA, 15 bp, Homo sapiens
tttcattaactaaat

SEQ ID NO: 6362 - DNA, 15 bp, Homo sapiens
atttcattaactaaa

SEQ ID NO: 6363 - DNA, 15 bp, Homo sapiens
aatttcattaactaa

SEQ ID NO: 6364 - DNA, 15 bp, Homo sapiens
aaatttcattaacta

SEQ ID NO: 6365 - DNA, 15 bp, Homo sapiens
caaatttcattaact

SEQ ID NO: 6366 - DNA, 15 bp, Homo sapiens
ccaaatttcattaac

SEQ ID NO: 6367 - DNA, 15 bp, Homo sapiens
cccaaatttcattaa

SEQ ID NO: 6368 - DNA, 15 bp, Homo sapiens
tcccaaatttcatta

SEQ ID NO: 6369 - DNA, 15 bp, Homo sapiens
atcccaaatttcatt

SEQ ID NO: 6370 - DNA, 15 bp, Homo sapiens
tatcccaaatttcat

SEQ ID NO: 6371 - DNA, 15 bp, Homo sapiens
atatcccaaatttca

SEQ ID NO: 6372 - DNA, 15 bp, Homo sapiens
tatatcccaaatttc

SEQ ID NO: 6373 - DNA, 15 bp, Homo sapiens
ctatatcccaaattt

SEQ ID NO: 6374 - DNA, 15 bp, Homo sapiens
actatatcccaaatt

SEQ ID NO: 6375 - DNA, 15 bp, Homo sapiens
gactatatcccaaat

SEQ ID NO: 6376 - DNA, 15 bp, Homo sapiens
agactatatcccaaa

SEQ ID NO: 6377 - DNA, 15 bp, Homo sapiens
aagactatatcccaa

SEQ ID NO: 6378 - DNA, 15 bp, Homo sapiens
aaagactatatccca

SEQ ID NO: 6379 - DNA, 15 bp, Homo sapiens
aaaagactatatccc

SEQ ID NO: 6380 - DNA, 15 bp, Homo sapiens
taaaagactatatcc

SEQ ID NO: 6381 - DNA, 15 bp, Homo sapiens
ataaaagactatatc

SEQ ID NO: 6382 - DNA, 15 bp, Homo sapiens
cataaaagactatat

SEQ ID NO: 6383 - DNA, 15 bp, Homo sapiens
tcataaaagactata

SEQ ID NO: 6384 - DNA, 15 bp, Homo sapiens
atcataaaagactat

SEQ ID NO: 6385 - DNA, 15 bp, Homo sapiens
aatcataaaagacta

SEQ ID NO: 6386 - DNA, 15 bp, Homo sapiens
caatcataaaagact

SEQ ID NO: 6387 - DNA, 15 bp, Homo sapiens
tcaatcataaaagac

SEQ ID NO: 6388 - DNA, 15 bp, Homo sapiens
ttcaatcataaaaga

SEQ ID NO: 6389 - DNA, 15 bp, Homo sapiens
tttcaatcataaaag

SEQ ID NO: 6390 - DNA, 15 bp, Homo sapiens
atttcaatcataaaa

SEQ ID NO: 6391 - DNA, 15 bp, Homo sapiens
tatttcaatcataaa

SEQ ID NO: 6392 - DNA, 15 bp, Homo sapiens
ttatttcaatcataa

SEQ ID NO: 6393 - DNA, 15 bp, Homo sapiens
attatttcaatcata

SEQ ID NO: 6394 - DNA, 15 bp, Homo sapiens
aattatttcaatcat

SEQ ID NO: 6395 - DNA, 15 bp, Homo sapiens
aaattatttcaatca

SEQ ID NO: 6396 - DNA, 15 bp, Homo sapiens
aaaattatttcaatc

SEQ ID NO: 6397 - DNA, 15 bp, Homo sapiens
caaaattatttcaat

SEQ ID NO: 6398 - DNA, 15 bp, Homo sapiens
gcaaaattatttcaa

SEQ ID NO: 6399 - DNA, 15 bp, Homo sapiens
agcaaaattatttca

SEQ ID NO: 6400 - DNA, 15 bp, Homo sapiens
tagcaaaattatttc

SEQ ID NO: 6401 - DNA, 15 bp, Homo sapiens
ttagcaaaattattt

SEQ ID NO: 6402 - DNA, 15 bp, Homo sapiens
tttagcaaaattatt

SEQ ID NO: 6403 - DNA, 15 bp, Homo sapiens
atttagcaaaattat

SEQ ID NO: 6404 - DNA, 15 bp, Homo sapiens
tatttagcaaaatta

SEQ ID NO: 6405 - DNA, 15 bp, Homo sapiens
ctatttagcaaaatt

SEQ ID NO: 6406 - DNA, 15 bp, Homo sapiens
tctatttagcaaaat

SEQ ID NO: 6407 - DNA, 15 bp, Homo sapiens
gtctatttagcaaaa

SEQ ID NO: 6408 - DNA, 15 bp, Homo sapiens
agtctatttagcaaa

SEQ ID NO: 6409 - DNA, 15 bp, Homo sapiens
cagtctatttagcaa

SEQ ID NO: 6410 - DNA, 15 bp, Homo sapiens
acagtctatttagca

SEQ ID NO: 6411 - DNA, 15 bp, Homo sapiens
gacagtctatttagc

SEQ ID NO: 6412 - DNA, 15 bp, Homo sapiens
agacagtctatttag

SEQ ID NO: 6413 - DNA, 15 bp, Homo sapiens
gagacagtctattta

SEQ ID NO: 6414 - DNA, 15 bp, Homo sapiens
agagacagtctattt

SEQ ID NO: 6415 - DNA, 15 bp, Homo sapiens
cagagacagtctatt

SEQ ID NO: 6416 - DNA, 15 bp, Homo sapiens
tcagagacagtctat

SEQ ID NO: 6417 - DNA, 15 bp, Homo sapiens
atcagagacagtcta

SEQ ID NO: 6418 - DNA, 15 bp, Homo sapiens
aatcagagacagtct

SEQ ID NO: 6419 - DNA, 15 bp, Homo sapiens
aaatcagagacagtc

SEQ ID NO: 6420 - DNA, 15 bp, Homo sapiens
taaatcagagacagt

SEQ ID NO: 6421 - DNA, 15 bp, Homo sapiens
ataaatcagagacag

SEQ ID NO: 6422 - DNA, 15 bp, Homo sapiens
aataaatcagagaca

SEQ ID NO: 6423 - DNA, 15 bp, Homo sapiens
taataaatcagagac

SEQ ID NO: 6424 - DNA, 15 bp, Homo sapiens
ctaataaatcagaga

SEQ ID NO: 6425 - DNA, 15 bp, Homo sapiens
cctaataaatcagag

SEQ ID NO: 6426 - DNA, 15 bp, Homo sapiens
acctaataaatcaga

SEQ ID NO: 6427 - DNA, 15 bp, Homo sapiens
tacctaataaatcag

SEQ ID NO: 6428 - DNA, 15 bp, Homo sapiens
ttacctaataaatca

SEQ ID NO: 6429 - DNA, 15 bp, Homo sapiens
attacctaataaatc

SEQ ID NO: 6430 - DNA, 15 bp, Homo sapiens
gattacctaataaat

SEQ ID NO: 6431 - DNA, 15 bp, Homo sapiens
tgattacctaataaa

SEQ ID NO: 6432 - DNA, 15 bp, Homo sapiens
gtgattacctaataa

SEQ ID NO: 6433 - DNA, 15 bp, Homo sapiens
ggtgattacctaata

SEQ ID NO: 6434 - DNA, 15 bp, Homo sapiens
tggtgattacctaat

SEQ ID NO: 6435 - DNA, 15 bp, Homo sapiens
gtggtgattacctaa

SEQ ID NO: 6436 - DNA, 15 bp, Homo sapiens
agtggtgattaccta

SEQ ID NO: 6437 - DNA, 15 bp, Homo sapiens
gagtggtgattacct

SEQ ID NO: 6438 - DNA, 15 bp, Homo sapiens
agagtggtgattacc

SEQ ID NO: 6439 - DNA, 15 bp, Homo sapiens
aagagtggtgattac

SEQ ID NO: 6440 - DNA, 15 bp, Homo sapiens
taagagtggtgatta

SEQ ID NO: 6441 - DNA, 15 bp, Homo sapiens
ataagagtggtgatt

SEQ ID NO: 6442 - DNA, 15 bp, Homo sapiens
aataagagtggtgat

SEQ ID NO: 6443 - DNA, 15 bp, Homo sapiens
aaataagagtggtga

SEQ ID NO: 6444 - DNA, 15 bp, Homo sapiens
aaaataagagtggtg

SEQ ID NO: 6445 - DNA, 15 bp, Homo sapiens
caaaataagagtggt

SEQ ID NO: 6446 - DNA, 15 bp, Homo sapiens
acaaaataagagtgg

SEQ ID NO: 6447 - DNA, 15 bp, Homo sapiens
aacaaaataagagtg

SEQ ID NO: 6448 - DNA, 15 bp, Homo sapiens
aaacaaaataagagt

SEQ ID NO: 6449 - DNA, 15 bp, Homo sapiens
aaaacaaaataagag

SEQ ID NO: 6450 - DNA, 15 bp, Homo sapiens
taaaacaaaataaga

SEQ ID NO: 6451 - DNA, 15 bp, Homo sapiens
gtaaaacaaaataag

SEQ ID NO: 6452 - DNA, 15 bp, Homo sapiens
agtaaaacaaaataa

SEQ ID NO: 6453 - DNA, 15 bp, Homo sapiens
aagtaaaacaaaata

SEQ ID NO: 6454 - DNA, 15 bp, Homo sapiens
gaagtaaaacaaaat

SEQ ID NO: 6455 - DNA, 15 bp, Homo sapiens
ggaagtaaaacaaaa

SEQ ID NO: 6456 - DNA, 15 bp, Homo sapiens
aggaagtaaaacaaa

SEQ ID NO: 6457 - DNA, 15 bp, Homo sapiens
aaggaagtaaaacaa

SEQ ID NO: 6458 - DNA, 15 bp, Homo sapiens
taaggaagtaaaaca

SEQ ID NO: 6459 - DNA, 15 bp, Homo sapiens
ttaaggaagtaaaac

SEQ ID NO: 6460 - DNA, 15 bp, Homo sapiens
attaaggaagtaaaa

SEQ ID NO: 6461 - DNA, 15 bp, Homo sapiens
cattaaggaagtaaa

SEQ ID NO: 6462 - DNA, 15 bp, Homo sapiens
acattaaggaagtaa

SEQ ID NO: 6463 - DNA, 15 bp, Homo sapiens
gacattaaggaagta

SEQ ID NO: 6464 - DNA, 15 bp, Homo sapiens
agacattaaggaagt

SEQ ID NO: 6465 - DNA, 15 bp, Homo sapiens
tagacattaaggaag

SEQ ID NO: 6466 - DNA, 15 bp, Homo sapiens
gtagacattaaggaa

SEQ ID NO: 6467 - DNA, 15 bp, Homo sapiens
tgtagacattaagga

SEQ ID NO: 6468 - DNA, 15 bp, Homo sapiens
atgtagacattaagg

SEQ ID NO: 6469 - DNA, 15 bp, Homo sapiens
tatgtagacattaag

SEQ ID NO: 6470 - DNA, 15 bp, Homo sapiens
ctatgtagacattaa

SEQ ID NO: 6471 - DNA, 15 bp, Homo sapiens
tctatgtagacatta

SEQ ID NO: 6472 - DNA, 15 bp, Homo sapiens
ttctatgtagacatt

SEQ ID NO: 6473 - DNA, 15 bp, Homo sapiens
tttctatgtagacat

SEQ ID NO: 6474 - DNA, 15 bp, Homo sapiens
ctttctatgtagaca

SEQ ID NO: 6475 - DNA, 15 bp, Homo sapiens
cctttctatgtagac

SEQ ID NO: 6476 - DNA, 15 bp, Homo sapiens
tcctttctatgtaga

SEQ ID NO: 6477 - DNA, 15 bp, Homo sapiens
ttcctttctatgtag

SEQ ID NO: 6478 - DNA, 15 bp, Homo sapiens
tttcctttctatgta

SEQ ID NO: 6479 - DNA, 15 bp, Homo sapiens
atttcctttctatgt

SEQ ID NO: 6480 - DNA, 15 bp, Homo sapiens
catttcctttctatg

SEQ ID NO: 6481 - DNA, 15 bp, Homo sapiens
tcatttcctttctat

SEQ ID NO: 6482 - DNA, 15 bp, Homo sapiens
ctcatttcctttcta

SEQ ID NO: 6483 - DNA, 15 bp, Homo sapiens
tctcatttcctttct

SEQ ID NO: 6484 - DNA, 15 bp, Homo sapiens
ttctcatttcctttc

SEQ ID NO: 6485 - DNA, 15 bp, Homo sapiens
tttctcatttccttt

SEQ ID NO: 6486 - DNA, 15 bp, Homo sapiens
ttttctcatttcctt

SEQ ID NO: 6487 - DNA, 15 bp, Homo sapiens
tttttctcatttcct

SEQ ID NO: 6488 - DNA, 15 bp, Homo sapiens
atttttctcatttcc

SEQ ID NO: 6489 - DNA, 15 bp, Homo sapiens
gatttttctcatttc

SEQ ID NO: 6490 - DNA, 15 bp, Homo sapiens
ggatttttctcattt

SEQ ID NO: 6491 - DNA, 15 bp, Homo sapiens
tggatttttctcatt

SEQ ID NO: 6492 - DNA, 15 bp, Homo sapiens
ctggatttttctcat

SEQ ID NO: 6493 - DNA, 15 bp, Homo sapiens
tctggatttttctca

SEQ ID NO: 6494 - DNA, 15 bp, Homo sapiens
ctctggatttttctc

SEQ ID NO: 6495 - DNA, 15 bp, Homo sapiens
cctctggatttttct

SEQ ID NO: 6496 - DNA, 15 bp, Homo sapiens
acctctggatttttc

SEQ ID NO: 6497 - DNA, 15 bp, Homo sapiens
aacctctggattttt

SEQ ID NO: 6498 - DNA, 15 bp, Homo sapiens
caacctctggatttt

SEQ ID NO: 6499 - DNA, 15 bp, Homo sapiens
acaacctctggattt

SEQ ID NO: 6500 - DNA, 15 bp, Homo sapiens
gacaacctctggatt

SEQ ID NO: 6501 - DNA, 15 bp, Homo sapiens
tgacaacctctggat

SEQ ID NO: 6502 - DNA, 15 bp, Homo sapiens
atgacaacctctgga

SEQ ID NO: 6503 - DNA, 15 bp, Homo sapiens
aatgacaacctctgg

SEQ ID NO: 6504 - DNA, 15 bp, Homo sapiens
aaatgacaacctctg

SEQ ID NO: 6505 - DNA, 15 bp, Homo sapiens
caaatgacaacctct

SEQ ID NO: 6506 - DNA, 15 bp, Homo sapiens
tcaaatgacaacctc

SEQ ID NO: 6507 - DNA, 15 bp, Homo sapiens
gtcaaatgacaacct

SEQ ID NO: 6508 - DNA, 15 bp, Homo sapiens
agtcaaatgacaacc

SEQ ID NO: 6509 - DNA, 15 bp, Homo sapiens
aagtcaaatgacaac

SEQ ID NO: 6510 - DNA, 15 bp, Homo sapiens
taagtcaaatgacaa

SEQ ID NO: 6511 - DNA, 15 bp, Homo sapiens
ataagtcaaatgaca

SEQ ID NO: 6512 - DNA, 15 bp, Homo sapiens
cataagtcaaatgac

SEQ ID NO: 6513 - DNA, 15 bp, Homo sapiens
tcataagtcaaatga

SEQ ID NO: 6514 - DNA, 15 bp, Homo sapiens
ctcataagtcaaatg

SEQ ID NO: 6515 - DNA, 15 bp, Homo sapiens
actcataagtcaaat

SEQ ID NO: 6516 - DNA, 15 bp, Homo sapiens
gactcataagtcaaa

SEQ ID NO: 6517 - DNA, 15 bp, Homo sapiens
agactcataagtcaa

SEQ ID NO: 6518 - DNA, 15 bp, Homo sapiens
cagactcataagtca

SEQ ID NO: 6519 - DNA, 15 bp, Homo sapiens
acagactcataagtc

SEQ ID NO: 6520 - DNA, 15 bp, Homo sapiens
aacagactcataagt

SEQ ID NO: 6521 - DNA, 15 bp, Homo sapiens
aaacagactcataag

SEQ ID NO: 6522 - DNA, 15 bp, Homo sapiens
caaacagactcataa

SEQ ID NO: 6523 - DNA, 15 bp, Homo sapiens
tcaaacagactcata

SEQ ID NO: 6524 - DNA, 15 bp, Homo sapiens
gtcaaacagactcat

SEQ ID NO: 6525 - DNA, 15 bp, Homo sapiens
agtcaaacagactca

SEQ ID NO: 6526 - DNA, 15 bp, Homo sapiens
aagtcaaacagactc

SEQ ID NO: 6527 - DNA, 15 bp, Homo sapiens
gaagtcaaacagact

SEQ ID NO: 6528 - DNA, 15 bp, Homo sapiens
tgaagtcaaacagac

SEQ ID NO: 6529 - DNA, 15 bp, Homo sapiens
ctgaagtcaaacaga

SEQ ID NO: 6530 - DNA, 15 bp, Homo sapiens
cctgaagtcaaacag

SEQ ID NO: 6531 - DNA, 15 bp, Homo sapiens
tcctgaagtcaaaca

SEQ ID NO: 6532 - DNA, 15 bp, Homo sapiens
atcctgaagtcaaac

SEQ ID NO: 6533 - DNA, 15 bp, Homo sapiens
aatcctgaagtcaaa

SEQ ID NO: 6534 - DNA, 15 bp, Homo sapiens
aaatcctgaagtcaa

SEQ ID NO: 6535 - DNA, 15 bp, Homo sapiens
caaatcctgaagtca

SEQ ID NO: 6536 - DNA, 15 bp, Homo sapiens
ccaaatcctgaagtc

SEQ ID NO: 6537 - DNA, 15 bp, Homo sapiens
accaaatcctgaagt

SEQ ID NO: 6538 - DNA, 15 bp, Homo sapiens
taccaaatcctgaag

SEQ ID NO: 6539 - DNA, 15 bp, Homo sapiens
gtaccaaatcctgaa

SEQ ID NO: 6540 - DNA, 15 bp, Homo sapiens
tgtaccaaatcctga

SEQ ID NO: 6541 - DNA, 15 bp, Homo sapiens
atgtaccaaatcctg

SEQ ID NO: 6542 - DNA, 15 bp, Homo sapiens
catgtaccaaatcct

SEQ ID NO: 6543 - DNA, 15 bp, Homo sapiens
tcatgtaccaaatcc

SEQ ID NO: 6544 - DNA, 15 bp, Homo sapiens
ttcatgtaccaaatc

SEQ ID NO: 6545 - DNA, 15 bp, Homo sapiens
tttcatgtaccaaat

SEQ ID NO: 6546 - DNA, 15 bp, Homo sapiens
atttcatgtaccaaa

SEQ ID NO: 6547 - DNA, 15 bp, Homo sapiens
aatttcatgtaccaa

SEQ ID NO: 6548 - DNA, 15 bp, Homo sapiens
aaatttcatgtacca

SEQ ID NO: 6549 - DNA, 15 bp, Homo sapiens
gaaatttcatgtacc

SEQ ID NO: 6550 - DNA, 15 bp, Homo sapiens
tgaaatttcatgtac

SEQ ID NO: 6551 - DNA, 15 bp, Homo sapiens
gtgaaatttcatgta

SEQ ID NO: 6552 - DNA, 15 bp, Homo sapiens
agtgaaatttcatgt

SEQ ID NO: 6553 - DNA, 15 bp, Homo sapiens
aagtgaaatttcatg

SEQ ID NO: 6554 - DNA, 15 bp, Homo sapiens
taagtgaaatttcat

SEQ ID NO: 6555 - DNA, 15 bp, Homo sapiens
ttaagtgaaatttca

SEQ ID NO: 6556 - DNA, 15 bp, Homo sapiens
attaagtgaaatttc

SEQ ID NO: 6557 - DNA, 15 bp, Homo sapiens
gattaagtgaaattt

SEQ ID NO: 6558 - DNA, 15 bp, Homo sapiens
agattaagtgaaatt

SEQ ID NO: 6559 - DNA, 15 bp, Homo sapiens
aagattaagtgaaat

SEQ ID NO: 6560 - DNA, 15 bp, Homo sapiens
aaagattaagtgaaa

SEQ ID NO: 6561 - DNA, 15 bp, Homo sapiens
aaaagattaagtgaa

SEQ ID NO: 6562 - DNA, 15 bp, Homo sapiens
aaaaagattaagtga

SEQ ID NO: 6563 - DNA, 15 bp, Homo sapiens
caaaaagattaagtg

SEQ ID NO: 6564 - DNA, 15 bp, Homo sapiens
tcaaaaagattaagt

SEQ ID NO: 6565 - DNA, 15 bp, Homo sapiens
atcaaaaagattaag

SEQ ID NO: 6566 - DNA, 15 bp, Homo sapiens
tatcaaaaagattaa

SEQ ID NO: 6567 - DNA, 15 bp, Homo sapiens
atatcaaaaagatta

SEQ ID NO: 6568 - DNA, 15 bp, Homo sapiens
catatcaaaaagatt

SEQ ID NO: 6569 - DNA, 15 bp, Homo sapiens
acatatcaaaaagat

SEQ ID NO: 6570 - DNA, 15 bp, Homo sapiens
tacatatcaaaaaga

SEQ ID NO: 6571 - DNA, 15 bp, Homo sapiens
atacatatcaaaaag

SEQ ID NO: 6572 - DNA, 15 bp, Homo sapiens
tatacatatcaaaaa

SEQ ID NO: 6573 - DNA, 15 bp, Homo sapiens
ttatacatatcaaaa

SEQ ID NO: 6574 - DNA, 15 bp, Homo sapiens
tttatacatatcaaa

SEQ ID NO: 6575 - DNA, 15 bp, Homo sapiens
ttttatacatatcaa

SEQ ID NO: 6576 - DNA, 15 bp, Homo sapiens
gttttatacatatca

SEQ ID NO: 6577 - DNA, 15 bp, Homo sapiens
tgttttatacatatc

SEQ ID NO: 6578 - DNA, 15 bp, Homo sapiens
ttgttttatacatat

SEQ ID NO: 6579 - DNA, 15 bp, Homo sapiens
tttgttttatacata

SEQ ID NO: 6580 - DNA, 15 bp, Homo sapiens
atttgttttatacat

SEQ ID NO: 6581 - DNA, 15 bp, Homo sapiens
tatttgttttataca

SEQ ID NO: 6582 - DNA, 15 bp, Homo sapiens
atatttgttttatac

SEQ ID NO: 6583 - DNA, 15 bp, Homo sapiens
aatatttgttttata

SEQ ID NO: 6584 - DNA, 15 bp, Homo sapiens
gaatatttgttttat

SEQ ID NO: 6585 - DNA, 15 bp, Homo sapiens
agaatatttgtttta

SEQ ID NO: 6586 - DNA, 15 bp, Homo sapiens
cagaatatttgtttt

SEQ ID NO: 6587 - DNA, 15 bp, Homo sapiens
ccagaatatttgttt

SEQ ID NO: 6588 - DNA, 15 bp, Homo sapiens
cccagaatatttgtt

SEQ ID NO: 6589 - DNA, 15 bp, Homo sapiens
acccagaatatttgt

SEQ ID NO: 6590 - DNA, 15 bp, Homo sapiens
tacccagaatatttg

SEQ ID NO: 6591 - DNA, 15 bp, Homo sapiens
ttacccagaatattt

SEQ ID NO: 6592 - DNA, 15 bp, Homo sapiens
attacccagaatatt

SEQ ID NO: 6593 - DNA, 15 bp, Homo sapiens
aattacccagaatat

SEQ ID NO: 6594 - DNA, 15 bp, Homo sapiens
taattacccagaata

SEQ ID NO: 6595 - DNA, 15 bp, Homo sapiens
ataattacccagaat

SEQ ID NO: 6596 - DNA, 15 bp, Homo sapiens
aataattacccagaa

SEQ ID NO: 6597 - DNA, 15 bp, Homo sapiens
aaataattacccaga

SEQ ID NO: 6598 - DNA, 15 bp, Homo sapiens
aaaataattacccag

SEQ ID NO: 6599 - DNA, 15 bp, Homo sapiens
aaaaataattaccca

SEQ ID NO: 6600 - DNA, 15 bp, Homo sapiens
taaaaataattaccc

SEQ ID NO: 6601 - DNA, 15 bp, Homo sapiens
ataaaaataattacc

SEQ ID NO: 6602 - DNA, 15 bp, Homo sapiens
gataaaaataattac

SEQ ID NO: 6603 - DNA, 15 bp, Homo sapiens
ggataaaaataatta

SEQ ID NO: 6604 - DNA, 15 bp, Homo sapiens
aggataaaaataatt

SEQ ID NO: 6605 - DNA, 15 bp, Homo sapiens
aaggataaaaataat

SEQ ID NO: 6606 - DNA, 15 bp, Homo sapiens
aaaggataaaaataa

SEQ ID NO: 6607 - DNA, 15 bp, Homo sapiens
aaaaggataaaaata

SEQ ID NO: 6608 - DNA, 15 bp, Homo sapiens
caaaaggataaaaat

SEQ ID NO: 6609 - DNA, 15 bp, Homo sapiens
ccaaaaggataaaaa

SEQ ID NO: 6610 - DNA, 15 bp, Homo sapiens
accaaaaggataaaa

SEQ ID NO: 6611 - DNA, 15 bp, Homo sapiens
aaccaaaaggataaa

SEQ ID NO: 6612 - DNA, 15 bp, Homo sapiens
aaaccaaaaggataa

SEQ ID NO: 6613 - DNA, 15 bp, Homo sapiens
aaaaccaaaaggata

SEQ ID NO: 6614 - DNA, 15 bp, Homo sapiens
caaaaccaaaaggat

SEQ ID NO: 6615 - DNA, 15 bp, Homo sapiens
tcaaaaccaaaagga

SEQ ID NO: 6616 - DNA, 15 bp, Homo sapiens
ctcaaaaccaaaagg

SEQ ID NO: 6617 - DNA, 15 bp, Homo sapiens
actcaaaaccaaaag

SEQ ID NO: 6618 - DNA, 15 bp, Homo sapiens
gactcaaaaccaaaa

SEQ ID NO: 6619 - DNA, 15 bp, Homo sapiens
ggactcaaaaccaaa

SEQ ID NO: 6620 - DNA, 15 bp, Homo sapiens
aggactcaaaaccaa

SEQ ID NO: 6621 - DNA, 15 bp, Homo sapiens
aaggactcaaaacca

SEQ ID NO: 6622 - DNA, 15 bp, Homo sapiens
aaaggactcaaaacc

SEQ ID NO: 6623 - DNA, 15 bp, Homo sapiens
aaaaggactcaaaac

SEQ ID NO: 6624 - DNA, 15 bp, Homo sapiens
aaaaaggactcaaaa

SEQ ID NO: 6625 - DNA, 15 bp, Homo sapiens
taaaaaggactcaaa

SEQ ID NO: 6626 - DNA, 15 bp, Homo sapiens
ataaaaaggactcaa

SEQ ID NO: 6627 - DNA, 15 bp, Homo sapiens
aataaaaaggactca

SEQ ID NO: 6628 - DNA, 15 bp, Homo sapiens
gaataaaaaggactc

SEQ ID NO: 6629 - DNA, 15 bp, Homo sapiens
ggaataaaaaggact

SEQ ID NO: 6630 - DNA, 15 bp, Homo sapiens
aggaataaaaaggac

SEQ ID NO: 6631 - DNA, 15 bp, Homo sapiens
taggaataaaaagga

SEQ ID NO: 6632 - DNA, 15 bp, Homo sapiens
ataggaataaaaagg

SEQ ID NO: 6633 - DNA, 15 bp, Homo sapiens
gataggaataaaaag

SEQ ID NO: 6634 - DNA, 15 bp, Homo sapiens
tgataggaataaaaa

SEQ ID NO: 6635 - DNA, 15 bp, Homo sapiens
atgataggaataaaa

SEQ ID NO: 6636 - DNA, 15 bp, Homo sapiens
tatgataggaataaa

SEQ ID NO: 6637 - DNA, 15 bp, Homo sapiens
atatgataggaataa

SEQ ID NO: 6638 - DNA, 15 bp, Homo sapiens
aatatgataggaata

SEQ ID NO: 6639 - DNA, 15 bp, Homo sapiens
caatatgataggaat

SEQ ID NO: 6640 - DNA, 15 bp, Homo sapiens
tcaatatgataggaa

SEQ ID NO: 6641 - DNA, 15 bp, Homo sapiens
ttcaatatgatagga

SEQ ID NO: 6642 - DNA, 15 bp, Homo sapiens
tttcaatatgatagg

SEQ ID NO: 6643 - DNA, 15 bp, Homo sapiens
atttcaatatgatag

SEQ ID NO: 6644 - DNA, 15 bp, Homo sapiens
aatttcaatatgata

SEQ ID NO: 6645 - DNA, 15 bp, Homo sapiens
caatttcaatatgat

SEQ ID NO: 6646 - DNA, 15 bp, Homo sapiens
ccaatttcaatatga

SEQ ID NO: 6647 - DNA, 15 bp, Homo sapiens
accaatttcaatatg

SEQ ID NO: 6648 - DNA, 15 bp, Homo sapiens
taccaatttcaatat

SEQ ID NO: 6649 - DNA, 15 bp, Homo sapiens
ttaccaatttcaata

SEQ ID NO: 6650 - DNA, 15 bp, Homo sapiens
cttaccaatttcaat

SEQ ID NO: 6651 - DNA, 15 bp, Homo sapiens
acttaccaatttcaa

SEQ ID NO: 6652 - DNA, 15 bp, Homo sapiens
aacttaccaatttca

SEQ ID NO: 6653 - DNA, 15 bp, Homo sapiens
taacttaccaatttc

SEQ ID NO: 6654 - DNA, 15 bp, Homo sapiens
ttaacttaccaattt

SEQ ID NO: 6655 - DNA, 15 bp, Homo sapiens
attaacttaccaatt

SEQ ID NO: 6656 - DNA, 15 bp, Homo sapiens
aattaacttaccaat

SEQ ID NO: 6657 - DNA, 15 bp, Homo sapiens
aaattaacttaccaa

SEQ ID NO: 6658 - DNA, 15 bp, Homo sapiens
aaaattaacttacca

SEQ ID NO: 6659 - DNA, 15 bp, Homo sapiens
gaaaattaacttacc

SEQ ID NO: 6660 - DNA, 15 bp, Homo sapiens
ggaaaattaacttac

SEQ ID NO: 6661 - DNA, 15 bp, Homo sapiens
aggaaaattaactta

SEQ ID NO: 6662 - DNA, 15 bp, Homo sapiens
aaggaaaattaactt

SEQ ID NO: 6663 - DNA, 15 bp, Homo sapiens
aaaggaaaattaact

SEQ ID NO: 6664 - DNA, 15 bp, Homo sapiens
caaaggaaaattaac

SEQ ID NO: 6665 - DNA, 15 bp, Homo sapiens
tcaaaggaaaattaa

SEQ ID NO: 6666 - DNA, 15 bp, Homo sapiens
ttcaaaggaaaatta

SEQ ID NO: 6667 - DNA, 15 bp, Homo sapiens
tttcaaaggaaaatt

SEQ ID NO: 6668 - DNA, 15 bp, Homo sapiens
atttcaaaggaaaat

SEQ ID NO: 6669 - DNA, 15 bp, Homo sapiens
tatttcaaaggaaaa

SEQ ID NO: 6670 - DNA, 15 bp, Homo sapiens
atatttcaaaggaaa

SEQ ID NO: 6671 - DNA, 15 bp, Homo sapiens
aatatttcaaaggaa

SEQ ID NO: 6672 - DNA, 15 bp, Homo sapiens
gaatatttcaaagga

SEQ ID NO: 6673 - DNA, 15 bp, Homo sapiens
ggaatatttcaaagg

SEQ ID NO: 6674 - DNA, 15 bp, Homo sapiens
aggaatatttcaaag

SEQ ID NO: 6675 - DNA, 15 bp, Homo sapiens
aaggaatatttcaaa

SEQ ID NO: 6676 - DNA, 15 bp, Homo sapiens
taaggaatatttcaa

SEQ ID NO: 6677 - DNA, 15 bp, Homo sapiens
ataaggaatatttca

SEQ ID NO: 6678 - DNA, 15 bp, Homo sapiens
tataaggaatatttc

SEQ ID NO: 6679 - DNA, 15 bp, Homo sapiens
ctataaggaatattt

SEQ ID NO: 6680 - DNA, 15 bp, Homo sapiens
gctataaggaatatt

SEQ ID NO: 6681 - DNA, 15 bp, Homo sapiens
ggctataaggaatat

SEQ ID NO: 6682 - DNA, 15 bp, Homo sapiens
tggctataaggaata

SEQ ID NO: 6683 - DNA, 15 bp, Homo sapiens
ctggctataaggaat

SEQ ID NO: 6684 - DNA, 15 bp, Homo sapiens
cctggctataaggaa

SEQ ID NO: 6685 - DNA, 15 bp, Homo sapiens
acctggctataagga

SEQ ID NO: 6686 - DNA, 15 bp, Homo sapiens
gacctggctataagg

SEQ ID NO: 6687 - DNA, 15 bp, Homo sapiens
agacctggctataag

SEQ ID NO: 6688 - DNA, 15 bp, Homo sapiens
tagacctggctataa

SEQ ID NO: 6689 - DNA, 15 bp, Homo sapiens
ttagacctggctata

SEQ ID NO: 6690 - DNA, 15 bp, Homo sapiens
tttagacctggctat

SEQ ID NO: 6691 - DNA, 15 bp, Homo sapiens
ttttagacctggcta

SEQ ID NO: 6692 - DNA, 15 bp, Homo sapiens
attttagacctggct

SEQ ID NO: 6693 - DNA, 15 bp, Homo sapiens
aattttagacctggc

SEQ ID NO: 6694 - DNA, 15 bp, Homo sapiens
gaattttagacctgg

SEQ ID NO: 6695 - DNA, 15 bp, Homo sapiens
tgaattttagacctg

SEQ ID NO: 6696 - DNA, 15 bp, Homo sapiens
ttgaattttagacct

SEQ ID NO: 6697 - DNA, 15 bp, Homo sapiens
attgaattttagacc

SEQ ID NO: 6698 - DNA, 15 bp, Homo sapiens
cattgaattttagac

SEQ ID NO: 6699 - DNA, 15 bp, Homo sapiens
ccattgaattttaga

SEQ ID NO: 6700 - DNA, 15 bp, Homo sapiens
gccattgaattttag

SEQ ID NO: 6701 - DNA, 15 bp, Homo sapiens
ggccattgaatttta

SEQ ID NO: 6702 - DNA, 15 bp, Homo sapiens
gggccattgaatttt

SEQ ID NO: 6703 - DNA, 15 bp, Homo sapiens
tgggccattgaattt

SEQ ID NO: 6704 - DNA, 15 bp, Homo sapiens
gtgggccattgaatt

SEQ ID NO: 6705 - DNA, 15 bp, Homo sapiens
ggtgggccattgaat

SEQ ID NO: 6706 - DNA, 15 bp, Homo sapiens
tggtgggccattgaa

SEQ ID NO: 6707 - DNA, 15 bp, Homo sapiens
gtggtgggccattga

SEQ ID NO: 6708 - DNA, 15 bp, Homo sapiens
ggtggtgggccattg

SEQ ID NO: 6709 - DNA, 15 bp, Homo sapiens
cggtggtgggccatt

SEQ ID NO: 6710 - DNA, 15 bp, Homo sapiens
gcggtggtgggccat

SEQ ID NO: 6711 - DNA, 15 bp, Homo sapiens
ggcggtggtgggcca

SEQ ID NO: 6712 - DNA, 15 bp, Homo sapiens
tggcggtggtgggcc

SEQ ID NO: 6713 - DNA, 15 bp, Homo sapiens
gtggcggtggtgggc

SEQ ID NO: 6714 - DNA, 15 bp, Homo sapiens
ggtggcggtggtggg

SEQ ID NO: 6715 - DNA, 15 bp, Homo sapiens
cggtggcggtggtgg

SEQ ID NO: 6716 - DNA, 15 bp, Homo sapiens
gcggtggcggtggtg

SEQ ID NO: 6717 - DNA, 15 bp, Homo sapiens
ggcggtggcggtggt

SEQ ID NO: 6718 - DNA, 15 bp, Homo sapiens
tggcggtggcggtgg

SEQ ID NO: 6719 - DNA, 15 bp, Homo sapiens
gtggcggtggcggtg

SEQ ID NO: 6720 - DNA, 15 bp, Homo sapiens
ggtggcggtggcggt

SEQ ID NO: 6721 - DNA, 15 bp, Homo sapiens
tggtggcggtggcgg

SEQ ID NO: 6722 - DNA, 15 bp, Homo sapiens
gtggtggcggtggcg

SEQ ID NO: 6723 - DNA, 15 bp, Homo sapiens
ggtggtggcggtggc

SEQ ID NO: 6724 - DNA, 15 bp, Homo sapiens
tggtggtggcggtgg

SEQ ID NO: 6725 - DNA, 15 bp, Homo sapiens
gtggtggtggcggtg

SEQ ID NO: 6726 - DNA, 15 bp, Homo sapiens
ggtggtggtggcggt

SEQ ID NO: 6727 - DNA, 15 bp, Homo sapiens
tggtggtggtggcgg

SEQ ID NO: 6728 - DNA, 15 bp, Homo sapiens
gtggtggtggtggcg

SEQ ID NO: 6729 - DNA, 15 bp, Homo sapiens
ggtggtggtggtggc

SEQ ID NO: 6730 - DNA, 15 bp, Homo sapiens
gggtggtggtggtgg

SEQ ID NO: 6731 - DNA, 15 bp, Homo sapiens
ggggtggtggtggtg

SEQ ID NO: 6732 - DNA, 15 bp, Homo sapiens
tggggtggtggtggt

SEQ ID NO: 6733 - DNA, 15 bp, Homo sapiens
gtggggtggtggtgg

SEQ ID NO: 6734 - DNA, 15 bp, Homo sapiens
agtggggtggtggtg

SEQ ID NO: 6735 - DNA, 15 bp, Homo sapiens
aagtggggtggtggt

SEQ ID NO: 6736 - DNA, 15 bp, Homo sapiens
taagtggggtggtgg

SEQ ID NO: 6737 - DNA, 15 bp, Homo sapiens
gtaagtggggtggtg

SEQ ID NO: 6738 - DNA, 15 bp, Homo sapiens
agtaagtggggtggt

SEQ ID NO: 6739 - DNA, 15 bp, Homo sapiens
tagtaagtggggtgg

SEQ ID NO: 6740 - DNA, 15 bp, Homo sapiens
atagtaagtggggtg

SEQ ID NO: 6741 - DNA, 15 bp, Homo sapiens
gatagtaagtggggt

SEQ ID NO: 6742 - DNA, 15 bp, Homo sapiens
tgatagtaagtgggg

SEQ ID NO: 6743 - DNA, 15 bp, Homo sapiens
atgatagtaagtggg

SEQ ID NO: 6744 - DNA, 15 bp, Homo sapiens
catgatagtaagtgg

SEQ ID NO: 6745 - DNA, 15 bp, Homo sapiens
gcatgatagtaagtg

SEQ ID NO: 6746 - DNA, 15 bp, Homo sapiens
agcatgatagtaagt

SEQ ID NO: 6747 - DNA, 15 bp, Homo sapiens
cagcatgatagtaag

SEQ ID NO: 6748 - DNA, 15 bp, Homo sapiens
ccagcatgatagtaa

SEQ ID NO: 6749 - DNA, 15 bp, Homo sapiens
gccagcatgatagta

SEQ ID NO: 6750 - DNA, 15 bp, Homo sapiens
agccagcatgatagt

SEQ ID NO: 6751 - DNA, 15 bp, Homo sapiens
cagccagcatgatag

SEQ ID NO: 6752 - DNA, 15 bp, Homo sapiens
gcagccagcatgata

SEQ ID NO: 6753 - DNA, 15 bp, Homo sapiens
ggcagccagcatgat

SEQ ID NO: 6754 - DNA, 15 bp, Homo sapiens
aggcagccagcatga

SEQ ID NO: 6755 - DNA, 15 bp, Homo sapiens
gaggcagccagcatg

SEQ ID NO: 6756 - DNA, 15 bp, Homo sapiens
ggaggcagccagcat

SEQ ID NO: 6757 - DNA, 15 bp, Homo sapiens
tggaggcagccagca

SEQ ID NO: 6758 - DNA, 15 bp, Homo sapiens
atggaggcagccagc

SEQ ID NO: 6759 - DNA, 15 bp, Homo sapiens
aatggaggcagccag

SEQ ID NO: 6760 - DNA, 15 bp, Homo sapiens
aaatggaggcagcca

SEQ ID NO: 6761 - DNA, 15 bp, Homo sapiens
gaaatggaggcagcc

SEQ ID NO: 6762 - DNA, 15 bp, Homo sapiens
ggaaatggaggcagc

SEQ ID NO: 6763 - DNA, 15 bp, Homo sapiens
aggaaatggaggcag

SEQ ID NO: 6764 - DNA, 15 bp, Homo sapiens
aaggaaatggaggca

SEQ ID NO: 6765 - DNA, 15 bp, Homo sapiens
gaaggaaatggaggc

SEQ ID NO: 6766 - DNA, 15 bp, Homo sapiens
agaaggaaatggagg

SEQ ID NO: 6767 - DNA, 15 bp, Homo sapiens
cagaaggaaatggag

SEQ ID NO: 6768 - DNA, 15 bp, Homo sapiens
ccagaaggaaatgga

SEQ ID NO: 6769 - DNA, 15 bp, Homo sapiens
tccagaaggaaatgg

SEQ ID NO: 6770 - DNA, 15 bp, Homo sapiens
gtccagaaggaaatg

SEQ ID NO: 6771 - DNA, 15 bp, Homo sapiens
ggtccagaaggaaat

SEQ ID NO: 6772 - DNA, 15 bp, Homo sapiens
tggtccagaaggaaa

SEQ ID NO: 6773 - DNA, 15 bp, Homo sapiens
gtggtccagaaggaa

SEQ ID NO: 6774 - DNA, 15 bp, Homo sapiens
ggtggtccagaagga

SEQ ID NO: 6775 - DNA, 15 bp, Homo sapiens
tggtggtccagaagg

SEQ ID NO: 6776 - DNA, 15 bp, Homo sapiens
ctggtggtccagaag

SEQ ID NO: 6777 - DNA, 15 bp, Homo sapiens
actggtggtccagaa

SEQ ID NO: 6778 - DNA, 15 bp, Homo sapiens
tactggtggtccaga

SEQ ID NO: 6779 - DNA, 15 bp, Homo sapiens
ttactggtggtccag

SEQ ID NO: 6780 - DNA, 15 bp, Homo sapiens
cttactggtggtcca

SEQ ID NO: 6781 - DNA, 15 bp, Homo sapiens
acttactggtggtcc

SEQ ID NO: 6782 - DNA, 15 bp, Homo sapiens
tacttactggtggtc

SEQ ID NO: 6783 - DNA, 15 bp, Homo sapiens
ttacttactggtggt

SEQ ID NO: 6784 - DNA, 15 bp, Homo sapiens
tttacttactggtgg

SEQ ID NO: 6785 - DNA, 15 bp, Homo sapiens
ttttacttactggtg

SEQ ID NO: 6786 - DNA, 15 bp, Homo sapiens
tttttacttactggt

SEQ ID NO: 6787 - DNA, 15 bp, Homo sapiens
ttttttacttactgg

SEQ ID NO: 6788 - DNA, 15 bp, Homo sapiens
cttttttacttactg

SEQ ID NO: 6789 - DNA, 15 bp, Homo sapiens
tcttttttacttact

SEQ ID NO: 6790 - DNA, 15 bp, Homo sapiens
ctcttttttacttac

SEQ ID NO: 6791 - DNA, 15 bp, Homo sapiens
actcttttttactta

SEQ ID NO: 6792 - DNA, 15 bp, Homo sapiens
tactcttttttactt

SEQ ID NO: 6793 - DNA, 15 bp, Homo sapiens
atactcttttttact

SEQ ID NO: 6794 - DNA, 15 bp, Homo sapiens
tatactcttttttac

SEQ ID NO: 6795 - DNA, 15 bp, Homo sapiens
ctatactctttttta

SEQ ID NO: 6796 - DNA, 15 bp, Homo sapiens
cctatactctttttt

SEQ ID NO: 6797 - DNA, 15 bp, Homo sapiens
acctatactcttttt

SEQ ID NO: 6798 - DNA, 15 bp, Homo sapiens
aacctatactctttt

SEQ ID NO: 6799 - DNA, 15 bp, Homo sapiens
taacctatactcttt

SEQ ID NO: 6800 - DNA, 15 bp, Homo sapiens
ctaacctatactctt

SEQ ID NO: 6801 - DNA, 15 bp, Homo sapiens
tctaacctatactct

SEQ ID NO: 6802 - DNA, 15 bp, Homo sapiens
atctaacctatactc

SEQ ID NO: 6803 - DNA, 15 bp, Homo sapiens
aatctaacctatact

SEQ ID NO: 6804 - DNA, 15 bp, Homo sapiens
aaatctaacctatac

SEQ ID NO: 6805 - DNA, 15 bp, Homo sapiens
aaaatctaacctata

SEQ ID NO: 6806 - DNA, 15 bp, Homo sapiens
caaaatctaacctat

SEQ ID NO: 6807 - DNA, 15 bp, Homo sapiens
gcaaaatctaaccta

SEQ ID NO: 6808 - DNA, 15 bp, Homo sapiens
agcaaaatctaacct

SEQ ID NO: 6809 - DNA, 15 bp, Homo sapiens
aagcaaaatctaacc

SEQ ID NO: 6810 - DNA, 15 bp, Homo sapiens
aaagcaaaatctaac

SEQ ID NO: 6811 - DNA, 15 bp, Homo sapiens
gaaagcaaaatctaa

SEQ ID NO: 6812 - DNA, 15 bp, Homo sapiens
tgaaagcaaaatcta

SEQ ID NO: 6813 - DNA, 15 bp, Homo sapiens
gtgaaagcaaaatct

SEQ ID NO: 6814 - DNA, 15 bp, Homo sapiens
tgtgaaagcaaaatc

SEQ ID NO: 6815 - DNA, 15 bp, Homo sapiens
atgtgaaagcaaaat

SEQ ID NO: 6816 - DNA, 15 bp, Homo sapiens
tatgtgaaagcaaaa

SEQ ID NO: 6817 - DNA, 15 bp, Homo sapiens
gtatgtgaaagcaaa

SEQ ID NO: 6818 - DNA, 15 bp, Homo sapiens
tgtatgtgaaagcaa

SEQ ID NO: 6819 - DNA, 15 bp, Homo sapiens
ttgtatgtgaaagca

SEQ ID NO: 6820 - DNA, 15 bp, Homo sapiens
attgtatgtgaaagc

SEQ ID NO: 6821 - DNA, 15 bp, Homo sapiens
aattgtatgtgaaag

SEQ ID NO: 6822 - DNA, 15 bp, Homo sapiens
aaattgtatgtgaaa

SEQ ID NO: 6823 - DNA, 15 bp, Homo sapiens
caaattgtatgtgaa

SEQ ID NO: 6824 - DNA, 15 bp, Homo sapiens
tcaaattgtatgtga

SEQ ID NO: 6825 - DNA, 15 bp, Homo sapiens
atcaaattgtatgtg

SEQ ID NO: 6826 - DNA, 15 bp, Homo sapiens
tatcaaattgtatgt

SEQ ID NO: 6827 - DNA, 15 bp, Homo sapiens
ttatcaaattgtatg

SEQ ID NO: 6828 - DNA, 15 bp, Homo sapiens
attatcaaattgtat

SEQ ID NO: 6829 - DNA, 15 bp, Homo sapiens
aattatcaaattgta

SEQ ID NO: 6830 - DNA, 15 bp, Homo sapiens
taattatcaaattgt

SEQ ID NO: 6831 - DNA, 15 bp, Homo sapiens
ctaattatcaaattg

SEQ ID NO: 6832 - DNA, 15 bp, Homo sapiens
gctaattatcaaatt

SEQ ID NO: 6833 - DNA, 15 bp, Homo sapiens
tgctaattatcaaat

SEQ ID NO: 6834 - DNA, 15 bp, Homo sapiens
ctgctaattatcaaa

SEQ ID NO: 6835 - DNA, 15 bp, Homo sapiens
tctgctaattatcaa

SEQ ID NO: 6836 - DNA, 15 bp, Homo sapiens
ttctgctaattatca

SEQ ID NO: 6837 - DNA, 15 bp, Homo sapiens
attctgctaattatc

SEQ ID NO: 6838 - DNA, 15 bp, Homo sapiens
tattctgctaattat

SEQ ID NO: 6839 - DNA, 15 bp, Homo sapiens
ctattctgctaatta

SEQ ID NO: 6840 - DNA, 15 bp, Homo sapiens
tctattctgctaatt

SEQ ID NO: 6841 - DNA, 15 bp, Homo sapiens
ctctattctgctaat

SEQ ID NO: 6842 - DNA, 15 bp, Homo sapiens
cctctattctgctaa

SEQ ID NO: 6843 - DNA, 15 bp, Homo sapiens
tcctctattctgcta

SEQ ID NO: 6844 - DNA, 15 bp, Homo sapiens
atcctctattctgct

SEQ ID NO: 6845 - DNA, 15 bp, Homo sapiens
aatcctctattctgc

SEQ ID NO: 6846 - DNA, 15 bp, Homo sapiens
caatcctctattctg

SEQ ID NO: 6847 - DNA, 15 bp, Homo sapiens
acaatcctctattct

SEQ ID NO: 6848 - DNA, 15 bp, Homo sapiens
tacaatcctctattc

SEQ ID NO: 6849 - DNA, 15 bp, Homo sapiens
ttacaatcctctatt

SEQ ID NO: 6850 - DNA, 15 bp, Homo sapiens
tttacaatcctctat

SEQ ID NO: 6851 - DNA, 15 bp, Homo sapiens
ttttacaatcctcta

SEQ ID NO: 6852 - DNA, 15 bp, Homo sapiens
attttacaatcctct

SEQ ID NO: 6853 - DNA, 15 bp, Homo sapiens
cattttacaatcctc

SEQ ID NO: 6854 - DNA, 15 bp, Homo sapiens
acattttacaatcct

SEQ ID NO: 6855 - DNA, 15 bp, Homo sapiens
gacattttacaatcc

SEQ ID NO: 6856 - DNA, 15 bp, Homo sapiens
tgacattttacaatc

SEQ ID NO: 6857 - DNA, 15 bp, Homo sapiens
atgacattttacaat

SEQ ID NO: 6858 - DNA, 15 bp, Homo sapiens
aatgacattttacaa

SEQ ID NO: 6859 - DNA, 15 bp, Homo sapiens
caatgacattttaca

SEQ ID NO: 6860 - DNA, 15 bp, Homo sapiens
acaatgacattttac

SEQ ID NO: 6861 - DNA, 15 bp, Homo sapiens
tacaatgacatttta

SEQ ID NO: 6862 - DNA, 15 bp, Homo sapiens
ctacaatgacatttt

SEQ ID NO: 6863 - DNA, 15 bp, Homo sapiens
tctacaatgacattt

SEQ ID NO: 6864 - DNA, 15 bp, Homo sapiens
ttctacaatgacatt

SEQ ID NO: 6865 - DNA, 15 bp, Homo sapiens
gttctacaatgacat

SEQ ID NO: 6866 - DNA, 15 bp, Homo sapiens
tgttctacaatgaca

SEQ ID NO: 6867 - DNA, 15 bp, Homo sapiens
atgttctacaatgac

SEQ ID NO: 6868 - DNA, 15 bp, Homo sapiens
gatgttctacaatga

SEQ ID NO: 6869 - DNA, 15 bp, Homo sapiens
ggatgttctacaatg

SEQ ID NO: 6870 - DNA, 15 bp, Homo sapiens
gggatgttctacaat

SEQ ID NO: 6871 - DNA, 15 bp, Homo sapiens
agggatgttctacaa

SEQ ID NO: 6872 - DNA, 15 bp, Homo sapiens
aagggatgttctaca

SEQ ID NO: 6873 - DNA, 15 bp, Homo sapiens
caagggatgttctac

SEQ ID NO: 6874 - DNA, 15 bp, Homo sapiens
ccaagggatgttcta

SEQ ID NO: 6875 - DNA, 15 bp, Homo sapiens
cccaagggatgttct

SEQ ID NO: 6876 - DNA, 15 bp, Homo sapiens
gcccaagggatgttc

SEQ ID NO: 6877 - DNA, 15 bp, Homo sapiens
ggcccaagggatgtt

SEQ ID NO: 6878 - DNA, 15 bp, Homo sapiens
tggcccaagggatgt

SEQ ID NO: 6879 - DNA, 15 bp, Homo sapiens
ctggcccaagggatg

SEQ ID NO: 6880 - DNA, 15 bp, Homo sapiens
tctggcccaagggat

SEQ ID NO: 6881 - DNA, 15 bp, Homo sapiens
atctggcccaaggga

SEQ ID NO: 6882 - DNA, 15 bp, Homo sapiens
aatctggcccaaggg

SEQ ID NO: 6883 - DNA, 15 bp, Homo sapiens
gaatctggcccaagg

SEQ ID NO: 6884 - DNA, 15 bp, Homo sapiens
agaatctggcccaag

SEQ ID NO: 6885 - DNA, 15 bp, Homo sapiens
tagaatctggcccaa

SEQ ID NO: 6886 - DNA, 15 bp, Homo sapiens
ttagaatctggccca

SEQ ID NO: 6887 - DNA, 15 bp, Homo sapiens
attagaatctggccc

SEQ ID NO: 6888 - DNA, 15 bp, Homo sapiens
cattagaatctggcc

SEQ ID NO: 6889 - DNA, 15 bp, Homo sapiens
ccattagaatctggc

SEQ ID NO: 6890 - DNA, 15 bp, Homo sapiens
cccattagaatctgg

SEQ ID NO: 6891 - DNA, 15 bp, Homo sapiens
acccattagaatctg

SEQ ID NO: 6892 - DNA, 15 bp, Homo sapiens
tacccattagaatct

SEQ ID NO: 6893 - DNA, 15 bp, Homo sapiens
ctacccattagaatc

SEQ ID NO: 6894 - DNA, 15 bp, Homo sapiens
tctacccattagaat

SEQ ID NO: 6895 - DNA, 15 bp, Homo sapiens
ttctacccattagaa

SEQ ID NO: 6896 - DNA, 15 bp, Homo sapiens
tttctacccattaga

SEQ ID NO: 6897 - DNA, 15 bp, Homo sapiens
atttctacccattag

SEQ ID NO: 6898 - DNA, 15 bp, Homo sapiens
aatttctacccatta

SEQ ID NO: 6899 - DNA, 15 bp, Homo sapiens
aaatttctacccatt

SEQ ID NO: 6900 - DNA, 15 bp, Homo sapiens
caaatttctacccat

SEQ ID NO: 6901 - DNA, 15 bp, Homo sapiens
tcaaatttctaccca

SEQ ID NO: 6902 - DNA, 15 bp, Homo sapiens
ttcaaatttctaccc

SEQ ID NO: 6903 - DNA, 15 bp, Homo sapiens
gttcaaatttctacc

SEQ ID NO: 6904 - DNA, 15 bp, Homo sapiens
agttcaaatttctac

SEQ ID NO: 6905 - DNA, 15 bp, Homo sapiens
tagttcaaatttcta

SEQ ID NO: 6906 - DNA, 15 bp, Homo sapiens
ttagttcaaatttct

SEQ ID NO: 6907 - DNA, 15 bp, Homo sapiens
tttagttcaaatttc

SEQ ID NO: 6908 - DNA, 15 bp, Homo sapiens
gtttagttcaaattt

SEQ ID NO: 6909 - DNA, 15 bp, Homo sapiens
ggtttagttcaaatt

SEQ ID NO: 6910 - DNA, 15 bp, Homo sapiens
aggtttagttcaaat

SEQ ID NO: 6911 - DNA, 15 bp, Homo sapiens
gaggtttagttcaaa

SEQ ID NO: 6912 - DNA, 15 bp, Homo sapiens
agaggtttagttcaa

SEQ ID NO: 6913 - DNA, 15 bp, Homo sapiens
cagaggtttagttca

SEQ ID NO: 6914 - DNA, 15 bp, Homo sapiens
ccagaggtttagttc

SEQ ID NO: 6915 - DNA, 15 bp, Homo sapiens
cccagaggtttagtt

SEQ ID NO: 6916 - DNA, 15 bp, Homo sapiens
acccagaggtttagt

SEQ ID NO: 6917 - DNA, 15 bp, Homo sapiens
aacccagaggtttag

SEQ ID NO: 6918 - DNA, 15 bp, Homo sapiens
aaacccagaggttta

SEQ ID NO: 6919 - DNA, 15 bp, Homo sapiens
aaaacccagaggttt

SEQ ID NO: 6920 - DNA, 15 bp, Homo sapiens
caaaacccagaggtt

SEQ ID NO: 6921 - DNA, 15 bp, Homo sapiens
acaaaacccagaggt

SEQ ID NO: 6922 - DNA, 15 bp, Homo sapiens
aacaaaacccagagg

SEQ ID NO: 6923 - DNA, 15 bp, Homo sapiens
aaacaaaacccagag

SEQ ID NO: 6924 - DNA, 15 bp, Homo sapiens
caaacaaaacccaga

SEQ ID NO: 6925 - DNA, 15 bp, Homo sapiens
acaaacaaaacccag

SEQ ID NO: 6926 - DNA, 15 bp, Homo sapiens
aacaaacaaaaccca

SEQ ID NO: 6927 - DNA, 15 bp, Homo sapiens
aaacaaacaaaaccc

SEQ ID NO: 6928 - DNA, 15 bp, Homo sapiens
aaaacaaacaaaacc

SEQ ID NO: 6929 - DNA, 15 bp, Homo sapiens
taaaaacaaacaaaa

SEQ ID NO: 6930 - DNA, 15 bp, Homo sapiens
ttaaaaacaaacaaa

SEQ ID NO: 6931 - DNA, 15 bp, Homo sapiens
attaaaaacaaacaa

SEQ ID NO: 6932 - DNA, 15 bp, Homo sapiens
cattaaaaacaaaca

SEQ ID NO: 6933 - DNA, 15 bp, Homo sapiens
gcattaaaaacaaac

SEQ ID NO: 6934 - DNA, 15 bp, Homo sapiens
ggcattaaaaacaaa

SEQ ID NO: 6935 - DNA, 15 bp, Homo sapiens
aggcattaaaaacaa

SEQ ID NO: 6936 - DNA, 15 bp, Homo sapiens
aaggcattaaaaaca

SEQ ID NO: 6937 - DNA, 15 bp, Homo sapiens
aaaggcattaaaaac

SEQ ID NO: 6938 - DNA, 15 bp, Homo sapiens
gaaaggcattaaaaa

SEQ ID NO: 6939 - DNA, 15 bp, Homo sapiens
agaaaggcattaaaa

SEQ ID NO: 6940 - DNA, 15 bp, Homo sapiens
cagaaaggcattaaa

SEQ ID NO: 6941 - DNA, 15 bp, Homo sapiens
acagaaaggcattaa

SEQ ID NO: 6942 - DNA, 15 bp, Homo sapiens
aacagaaaggcatta

SEQ ID NO: 6943 - DNA, 15 bp, Homo sapiens
taacagaaaggcatt

SEQ ID NO: 6944 - DNA, 15 bp, Homo sapiens
gtaacagaaaggcat

SEQ ID NO: 6945 - DNA, 15 bp, Homo sapiens
ggtaacagaaaggca

SEQ ID NO: 6946 - DNA, 15 bp, Homo sapiens
gggtaacagaaaggc

SEQ ID NO: 6947 - DNA, 15 bp, Homo sapiens
tgggtaacagaaagg

SEQ ID NO: 6948 - DNA, 15 bp, Homo sapiens
ctgggtaacagaaag

SEQ ID NO: 6949 - DNA, 15 bp, Homo sapiens
tctgggtaacagaaa

SEQ ID NO: 6950 - DNA, 15 bp, Homo sapiens
atctgggtaacagaa

SEQ ID NO: 6951 - DNA, 15 bp, Homo sapiens
catctgggtaacaga

SEQ ID NO: 6952 - DNA, 15 bp, Homo sapiens
gcatctgggtaacag

SEQ ID NO: 6953 - DNA, 15 bp, Homo sapiens
tgcatctgggtaaca

SEQ ID NO: 6954 - DNA, 15 bp, Homo sapiens
ctgcatctgggtaac

SEQ ID NO: 6955 - DNA, 15 bp, Homo sapiens
actgcatctgggtaa

SEQ ID NO: 6956 - DNA, 15 bp, Homo sapiens
cactgcatctgggta

SEQ ID NO: 6957 - DNA, 15 bp, Homo sapiens
gcactgcatctgggt

SEQ ID NO: 6958 - DNA, 15 bp, Homo sapiens
agcactgcatctggg

SEQ ID NO: 6959 - DNA, 15 bp, Homo sapiens
gagcactgcatctgg

SEQ ID NO: 6960 - DNA, 15 bp, Homo sapiens
agagcactgcatctg

SEQ ID NO: 6961 - DNA, 15 bp, Homo sapiens
aagagcactgcatct

SEQ ID NO: 6962 - DNA, 15 bp, Homo sapiens
caagagcactgcatc

SEQ ID NO: 6963 - DNA, 15 bp, Homo sapiens
acaagagcactgcat

SEQ ID NO: 6964 - DNA, 15 bp, Homo sapiens
tacaagagcactgca

SEQ ID NO: 6965 - DNA, 15 bp, Homo sapiens
ctacaagagcactgc

SEQ ID NO: 6966 - DNA, 15 bp, Homo sapiens
actacaagagcactg

SEQ ID NO: 6967 - DNA, 15 bp, Homo sapiens
gactacaagagcact

SEQ ID NO: 6968 - DNA, 15 bp, Homo sapiens
ggactacaagagcac

SEQ ID NO: 6969 - DNA, 15 bp, Homo sapiens
gggactacaagagca

SEQ ID NO: 6970 - DNA, 15 bp, Homo sapiens
tgggactacaagagc

SEQ ID NO: 6971 - DNA, 15 bp, Homo sapiens
ttgggactacaagag

SEQ ID NO: 6972 - DNA, 15 bp, Homo sapiens
cttgggactacaaga

SEQ ID NO: 6973 - DNA, 15 bp, Homo sapiens
acttgggactacaag

SEQ ID NO: 6974 - DNA, 15 bp, Homo sapiens
gacttgggactacaa

SEQ ID NO: 6975 - DNA, 15 bp, Homo sapiens
agacttgggactaca

SEQ ID NO: 6976 - DNA, 15 bp, Homo sapiens
tagacttgggactac

SEQ ID NO: 6977 - DNA, 15 bp, Homo sapiens
ttagacttgggacta

SEQ ID NO: 6978 - DNA, 15 bp, Homo sapiens
cttagacttgggact

SEQ ID NO: 6979 - DNA, 15 bp, Homo sapiens
gcttagacttgggac

SEQ ID NO: 6980 - DNA, 15 bp, Homo sapiens
agcttagacttggga

SEQ ID NO: 6981 - DNA, 15 bp, Homo sapiens
gagcttagacttggg

SEQ ID NO: 6982 - DNA, 15 bp, Homo sapiens
agagcttagacttgg

SEQ ID NO: 6983 - DNA, 15 bp, Homo sapiens
tagagcttagacttg

SEQ ID NO: 6984 - DNA, 15 bp, Homo sapiens
ctagagcttagactt

SEQ ID NO: 6985 - DNA, 15 bp, Homo sapiens
cctagagcttagact

SEQ ID NO: 6986 - DNA, 15 bp, Homo sapiens
acctagagcttagac

SEQ ID NO: 6987 - DNA, 15 bp, Homo sapiens
aacctagagcttaga

SEQ ID NO: 6988 - DNA, 15 bp, Homo sapiens
caacctagagcttag

SEQ ID NO: 6989 - DNA, 15 bp, Homo sapiens
gcaacctagagctta

SEQ ID NO: 6990 - DNA, 15 bp, Homo sapiens
ggcaacctagagctt

SEQ ID NO: 6991 - DNA, 15 bp, Homo sapiens
aggcaacctagagct

SEQ ID NO: 6992 - DNA, 15 bp, Homo sapiens
aaggcaacctagagc

SEQ ID NO: 6993 - DNA, 15 bp, Homo sapiens
gaaggcaacctagag

SEQ ID NO: 6994 - DNA, 15 bp, Homo sapiens
agaaggcaacctaga

SEQ ID NO: 6995 - DNA, 15 bp, Homo sapiens
aagaaggcaacctag

SEQ ID NO: 6996 - DNA, 15 bp, Homo sapiens
aaagaaggcaaccta

SEQ ID NO: 6997 - DNA, 15 bp, Homo sapiens
gaaagaaggcaacct

SEQ ID NO: 6998 - DNA, 15 bp, Homo sapiens
ggaaagaaggcaacc

SEQ ID NO: 6999 - DNA, 15 bp, Homo sapiens
aggaaagaaggcaac

SEQ ID NO: 7000 - DNA, 15 bp, Homo sapiens
caggaaagaaggcaa

SEQ ID NO: 7001 - DNA, 15 bp, Homo sapiens
ccaggaaagaaggca

SEQ ID NO: 7002 - DNA, 15 bp, Homo sapiens
gccaggaaagaaggc

SEQ ID NO: 7003 - DNA, 15 bp, Homo sapiens
tgccaggaaagaagg

SEQ ID NO: 7004 - DNA, 15 bp, Homo sapiens
ctgccaggaaagaag

SEQ ID NO: 7005 - DNA, 15 bp, Homo sapiens
tctgccaggaaagaa

SEQ ID NO: 7006 - DNA, 15 bp, Homo sapiens
ttctgccaggaaaga

SEQ ID NO: 7007 - DNA, 15 bp, Homo sapiens
cttctgccaggaaag

SEQ ID NO: 7008 - DNA, 15 bp, Homo sapiens
acttctgccaggaaa

SEQ ID NO: 7009 - DNA, 15 bp, Homo sapiens
aacttctgccaggaa

SEQ ID NO: 7010 - DNA, 15 bp, Homo sapiens
caacttctgccagga

SEQ ID NO: 7011 - DNA, 15 bp, Homo sapiens
ccaacttctgccagg

SEQ ID NO: 7012 - DNA, 15 bp, Homo sapiens
accaacttctgccag

SEQ ID NO: 7013 - DNA, 15 bp, Homo sapiens
caccaacttctgcca

SEQ ID NO: 7014 - DNA, 15 bp, Homo sapiens
acaccaacttctgcc

SEQ ID NO: 7015 - DNA, 15 bp, Homo sapiens
gacaccaacttctgc

SEQ ID NO: 7016 - DNA, 15 bp, Homo sapiens
agacaccaacttctg

SEQ ID NO: 7017 - DNA, 15 bp, Homo sapiens
tagacaccaacttct

SEQ ID NO: 7018 - DNA, 15 bp, Homo sapiens
atagacaccaacttc

SEQ ID NO: 7019 - DNA, 15 bp, Homo sapiens
catagacaccaactt

SEQ ID NO: 7020 - DNA, 15 bp, Homo sapiens
gcatagacaccaact

SEQ ID NO: 7021 - DNA, 15 bp, Homo sapiens
ggcatagacaccaac

SEQ ID NO: 7022 - DNA, 15 bp, Homo sapiens
tggcatagacaccaa

SEQ ID NO: 7023 - DNA, 15 bp, Homo sapiens
atggcatagacacca

SEQ ID NO: 7024 - DNA, 15 bp, Homo sapiens
tatggcatagacacc

SEQ ID NO: 7025 - DNA, 15 bp, Homo sapiens
ttatggcatagacac

SEQ ID NO: 7026 - DNA, 15 bp, Homo sapiens
cttatggcatagaca

SEQ ID NO: 7027 - DNA, 15 bp, Homo sapiens
ccttatggcatagac

SEQ ID NO: 7028 - DNA, 15 bp, Homo sapiens
tccttatggcataga

SEQ ID NO: 7029 - DNA, 15 bp, Homo sapiens
ctccttatggcatag

SEQ ID NO: 7030 - DNA, 15 bp, Homo sapiens
cctccttatggcata

SEQ ID NO: 7031 - DNA, 15 bp, Homo sapiens
acctccttatggcat

SEQ ID NO: 7032 - DNA, 15 bp, Homo sapiens
tacctccttatggca

SEQ ID NO: 7033 - DNA, 15 bp, Homo sapiens
ctacctccttatggc

SEQ ID NO: 7034 - DNA, 15 bp, Homo sapiens
actacctccttatgg

SEQ ID NO: 7035 - DNA, 15 bp, Homo sapiens
aactacctccttatg

SEQ ID NO: 7036 - DNA, 15 bp, Homo sapiens
gaactacctccttat

SEQ ID NO: 7037 - DNA, 15 bp, Homo sapiens
ggaactacctcctta

SEQ ID NO: 7038 - DNA, 15 bp, Homo sapiens
aggaactacctcctt

SEQ ID NO: 7039 - DNA, 15 bp, Homo sapiens
caggaactacctcct

SEQ ID NO: 7040 - DNA, 15 bp, Homo sapiens
acaggaactacctcc

SEQ ID NO: 7041 - DNA, 15 bp, Homo sapiens
aacaggaactacctc

SEQ ID NO: 7042 - DNA, 15 bp, Homo sapiens
taacaggaactacct

SEQ ID NO: 7043 - DNA, 15 bp, Homo sapiens
ctaacaggaactacc

SEQ ID NO: 7044 - DNA, 15 bp, Homo sapiens
tctaacaggaactac

SEQ ID NO: 7045 - DNA, 15 bp, Homo sapiens
ttctaacaggaacta

SEQ ID NO: 7046 - DNA, 15 bp, Homo sapiens
cttctaacaggaact

SEQ ID NO: 7047 - DNA, 15 bp, Homo sapiens
ccttctaacaggaac

SEQ ID NO: 7048 - DNA, 15 bp, Homo sapiens
cccttctaacaggaa

SEQ ID NO: 7049 - DNA, 15 bp, Homo sapiens
tcccttctaacagga

SEQ ID NO: 7050 - DNA, 15 bp, Homo sapiens
atcccttctaacagg

SEQ ID NO: 7051 - DNA, 15 bp, Homo sapiens
aatcccttctaacag

SEQ ID NO: 7052 - DNA, 15 bp, Homo sapiens
aaatcccttctaaca

SEQ ID NO: 7053 - DNA, 15 bp, Homo sapiens
taaatcccttctaac

SEQ ID NO: 7054 - DNA, 15 bp, Homo sapiens
ttaaatcccttctaa

SEQ ID NO: 7055 - DNA, 15 bp, Homo sapiens
attaaatcccttcta

SEQ ID NO: 7056 - DNA, 15 bp, Homo sapiens
aattaaatcccttct

SEQ ID NO: 7057 - DNA, 15 bp, Homo sapiens
taattaaatcccttc

SEQ ID NO: 7058 - DNA, 15 bp, Homo sapiens
ataattaaatccctt

SEQ ID NO: 7059 - DNA, 15 bp, Homo sapiens
tataattaaatccct

SEQ ID NO: 7060 - DNA, 15 bp, Homo sapiens
gtataattaaatccc

SEQ ID NO: 7061 - DNA, 15 bp, Homo sapiens
ggtataattaaatcc

SEQ ID NO: 7062 - DNA, 15 bp, Homo sapiens
aggtataattaaatc

SEQ ID NO: 7063 - DNA, 15 bp, Homo sapiens
aaggtataattaaat

SEQ ID NO: 7064 - DNA, 15 bp, Homo sapiens
taaggtataattaaa

SEQ ID NO: 7065 - DNA, 15 bp, Homo sapiens
ataaggtataattaa

SEQ ID NO: 7066 - DNA, 15 bp, Homo sapiens
tataaggtataatta

SEQ ID NO: 7067 - DNA, 15 bp, Homo sapiens
atataaggtataatt

SEQ ID NO: 7068 - DNA, 15 bp, Homo sapiens
tatataaggtataat

SEQ ID NO: 7069 - DNA, 15 bp, Homo sapiens
ttatataaggtataa

SEQ ID NO: 7070 - DNA, 15 bp, Homo sapiens
cttatataaggtata

SEQ ID NO: 7071 - DNA, 15 bp, Homo sapiens
ccttatataaggtat

SEQ ID NO: 7072 - DNA, 15 bp, Homo sapiens
tccttatataaggta

SEQ ID NO: 7073 - DNA, 15 bp, Homo sapiens
ttccttatataaggt

SEQ ID NO: 7074 - DNA, 15 bp, Homo sapiens
attccttatataagg

SEQ ID NO: 7075 - DNA, 15 bp, Homo sapiens
aattccttatataag

SEQ ID NO: 7076 - DNA, 15 bp, Homo sapiens
taattccttatataa

SEQ ID NO: 7077 - DNA, 15 bp, Homo sapiens
ctaattccttatata

SEQ ID NO: 7078 - DNA, 15 bp, Homo sapiens
actaattccttatat

SEQ ID NO: 7079 - DNA, 15 bp, Homo sapiens
cactaattccttata

SEQ ID NO: 7080 - DNA, 15 bp, Homo sapiens
acactaattccttat

SEQ ID NO: 7081 - DNA, 15 bp, Homo sapiens
aacactaattcctta

SEQ ID NO: 7082 - DNA, 15 bp, Homo sapiens
aaacactaattcctt

SEQ ID NO: 7083 - DNA, 15 bp, Homo sapiens
caaacactaattcct

SEQ ID NO: 7084 - DNA, 15 bp, Homo sapiens
gcaaacactaattcc

SEQ ID NO: 7085 - DNA, 15 bp, Homo sapiens
ggcaaacactaattc

SEQ ID NO: 7086 - DNA, 15 bp, Homo sapiens
gggcaaacactaatt

SEQ ID NO: 7087 - DNA, 15 bp, Homo sapiens
agggcaaacactaat

SEQ ID NO: 7088 - DNA, 15 bp, Homo sapiens
aagggcaaacactaa

SEQ ID NO: 7089 - DNA, 15 bp, Homo sapiens
gaagggcaaacacta

SEQ ID NO: 7090 - DNA, 15 bp, Homo sapiens
agaagggcaaacact

SEQ ID NO: 7091 - DNA, 15 bp, Homo sapiens
tagaagggcaaacac

SEQ ID NO: 7092 - DNA, 15 bp, Homo sapiens
ctagaagggcaaaca

SEQ ID NO: 7093 - DNA, 15 bp, Homo sapiens
cctagaagggcaaac

SEQ ID NO: 7094 - DNA, 15 bp, Homo sapiens
acctagaagggcaaa

SEQ ID NO: 7095 - DNA, 15 bp, Homo sapiens
tacctagaagggcaa

SEQ ID NO: 7096 - DNA, 15 bp, Homo sapiens
atacctagaagggca

SEQ ID NO: 7097 - DNA, 15 bp, Homo sapiens
tatacctagaagggc

SEQ ID NO: 7098 - DNA, 15 bp, Homo sapiens
ctatacctagaaggg

SEQ ID NO: 7099 - DNA, 15 bp, Homo sapiens
actatacctagaagg

SEQ ID NO: 7100 - DNA, 15 bp, Homo sapiens
aactatacctagaag

SEQ ID NO: 7101 - DNA, 15 bp, Homo sapiens
caactatacctagaa

SEQ ID NO: 7102 - DNA, 15 bp, Homo sapiens
ccaactatacctaga

SEQ ID NO: 7103 - DNA, 15 bp, Homo sapiens
tccaactatacctag

SEQ ID NO: 7104 - DNA, 15 bp, Homo sapiens
atccaactataccta

SEQ ID NO: 7105 - DNA, 15 bp, Homo sapiens
catccaactatacct

SEQ ID NO: 7106 - DNA, 15 bp, Homo sapiens
acatccaactatacc

SEQ ID NO: 7107 - DNA, 15 bp, Homo sapiens
aacatccaactatac

SEQ ID NO: 7108 - DNA, 15 bp, Homo sapiens
taacatccaactata

SEQ ID NO: 7109 - DNA, 15 bp, Homo sapiens
ctaacatccaactat

SEQ ID NO: 7110 - DNA, 15 bp, Homo sapiens
gctaacatccaacta

SEQ ID NO: 7111 - DNA, 15 bp, Homo sapiens
agctaacatccaact

SEQ ID NO: 7112 - DNA, 15 bp, Homo sapiens
aagctaacatccaac

SEQ ID NO: 7113 - DNA, 15 bp, Homo sapiens
gaagctaacatccaa

SEQ ID NO: 7114 - DNA, 15 bp, Homo sapiens
agaagctaacatcca

SEQ ID NO: 7115 - DNA, 15 bp, Homo sapiens
cagaagctaacatcc

SEQ ID NO: 7116 - DNA, 15 bp, Homo sapiens
tcagaagctaacatc

SEQ ID NO: 7117 - DNA, 15 bp, Homo sapiens
atcagaagctaacat

SEQ ID NO: 7118 - DNA, 15 bp, Homo sapiens
catcagaagctaaca

SEQ ID NO: 7119 - DNA, 15 bp, Homo sapiens
acatcagaagctaac

SEQ ID NO: 7120 - DNA, 15 bp, Homo sapiens
tacatcagaagctaa

SEQ ID NO: 7121 - DNA, 15 bp, Homo sapiens
ttacatcagaagcta

SEQ ID NO: 7122 - DNA, 15 bp, Homo sapiens
tttacatcagaagct

SEQ ID NO: 7123 - DNA, 15 bp, Homo sapiens
gtttacatcagaagc

SEQ ID NO: 7124 - DNA, 15 bp, Homo sapiens
agtttacatcagaag

SEQ ID NO: 7125 - DNA, 15 bp, Homo sapiens
cagtttacatcagaa

SEQ ID NO: 7126 - DNA, 15 bp, Homo sapiens
ccagtttacatcaga

SEQ ID NO: 7127 - DNA, 15 bp, Homo sapiens
tccagtttacatcag

SEQ ID NO: 7128 - DNA, 15 bp, Homo sapiens
atccagtttacatca

SEQ ID NO: 7129 - DNA, 15 bp, Homo sapiens
aatccagtttacatc

SEQ ID NO: 7130 - DNA, 15 bp, Homo sapiens
aaatccagtttacat

SEQ ID NO: 7131 - DNA, 15 bp, Homo sapiens
gaaatccagtttaca

SEQ ID NO: 7132 - DNA, 15 bp, Homo sapiens
agaaatccagtttac

SEQ ID NO: 7133 - DNA, 15 bp, Homo sapiens
aagaaatccagttta

SEQ ID NO: 7134 - DNA, 15 bp, Homo sapiens
aaagaaatccagttt

SEQ ID NO: 7135 - DNA, 15 bp, Homo sapiens
aaaagaaatccagtt

SEQ ID NO: 7136 - DNA, 15 bp, Homo sapiens
aaaaagaaatccagt

SEQ ID NO: 7137 - DNA, 15 bp, Homo sapiens
gaaaaagaaatccag

SEQ ID NO: 7138 - DNA, 15 bp, Homo sapiens
agaaaaagaaatcca

SEQ ID NO: 7139 - DNA, 15 bp, Homo sapiens
aagaaaaagaaatcc

SEQ ID NO: 7140 - DNA, 15 bp, Homo sapiens
aaagaaaaagaaatc

SEQ ID NO: 7141 - DNA, 15 bp, Homo sapiens
gaaagaaaaagaaat

SEQ ID NO: 7142 - DNA, 15 bp, Homo sapiens
agaaagaaaaagaaa

SEQ ID NO: 7143 - DNA, 15 bp, Homo sapiens
gagaaagaaaaagaa

SEQ ID NO: 7144 - DNA, 15 bp, Homo sapiens
agagaaagaaaaaga

SEQ ID NO: 7145 - DNA, 15 bp, Homo sapiens
gagagaaagaaaaag

SEQ ID NO: 7146 - DNA, 15 bp, Homo sapiens
agagagaaagaaaaa

SEQ ID NO: 7147 - DNA, 15 bp, Homo sapiens
gagagagaaagaaaa

SEQ ID NO: 7148 - DNA, 15 bp, Homo sapiens
agagagagaaagaaa

SEQ ID NO: 7149 - DNA, 15 bp, Homo sapiens
aagagagagaaagaa

SEQ ID NO: 7150 - DNA, 15 bp, Homo sapiens
aaagagagagaaaga

SEQ ID NO: 7151 - DNA, 15 bp, Homo sapiens
aaaagagagagaaag

SEQ ID NO: 7152 - DNA, 15 bp, Homo sapiens
aaaaagagagagaaa

SEQ ID NO: 7153 - DNA, 15 bp, Homo sapiens
aaaaaagagagagaa

SEQ ID NO: 7154 - DNA, 15 bp, Homo sapiens
aaaaaaagagagaga

SEQ ID NO: 7155 - DNA, 15 bp, Homo sapiens
aaaaaaaagagagag

SEQ ID NO: 7156 - DNA, 15 bp, Homo sapiens
caaaaaaaaaaaaag

SEQ ID NO: 7157 - DNA, 15 bp, Homo sapiens
caaaacaaaaaaaaa

SEQ ID NO: 7158 - DNA, 15 bp, Homo sapiens
ccaaaacaaaaaaaa

SEQ ID NO: 7159 - DNA, 15 bp, Homo sapiens
tccaaaacaaaaaaa

SEQ ID NO: 7160 - DNA, 15 bp, Homo sapiens
ctccaaaacaaaaaa

SEQ ID NO: 7161 - DNA, 15 bp, Homo sapiens
cctccaaaacaaaaa

SEQ ID NO: 7162 - DNA, 15 bp, Homo sapiens
gcctccaaaacaaaa

SEQ ID NO: 7163 - DNA, 15 bp, Homo sapiens
tgcctccaaaacaaa

SEQ ID NO: 7164 - DNA, 15 bp, Homo sapiens
ctgcctccaaaacaa

SEQ ID NO: 7165 - DNA, 15 bp, Homo sapiens
tctgcctccaaaaca

SEQ ID NO: 7166 - DNA, 15 bp, Homo sapiens
ctctgcctccaaaac

SEQ ID NO: 7167 - DNA, 15 bp, Homo sapiens
actctgcctccaaaa

SEQ ID NO: 7168 - DNA, 15 bp, Homo sapiens
aactctgcctccaaa

SEQ ID NO: 7169 - DNA, 15 bp, Homo sapiens
aaactctgcctccaa

SEQ ID NO: 7170 - DNA, 15 bp, Homo sapiens
aaaactctgcctcca

SEQ ID NO: 7171 - DNA, 15 bp, Homo sapiens
caaaactctgcctcc

SEQ ID NO: 7172 - DNA, 15 bp, Homo sapiens
gcaaaactctgcctc

SEQ ID NO: 7173 - DNA, 15 bp, Homo sapiens
ggcaaaactctgcct

SEQ ID NO: 7174 - DNA, 15 bp, Homo sapiens
gggcaaaactctgcc

SEQ ID NO: 7175 - DNA, 15 bp, Homo sapiens
agggcaaaactctgc

SEQ ID NO: 7176 - DNA, 15 bp, Homo sapiens
aagggcaaaactctg

SEQ ID NO: 7177 - DNA, 15 bp, Homo sapiens
caagggcaaaactct

SEQ ID NO: 7178 - DNA, 15 bp, Homo sapiens
acaagggcaaaactc

SEQ ID NO: 7179 - DNA, 15 bp, Homo sapiens
tacaagggcaaaact

SEQ ID NO: 7180 - DNA, 15 bp, Homo sapiens
gtacaagggcaaaac

SEQ ID NO: 7181 - DNA, 15 bp, Homo sapiens
ggtacaagggcaaaa

SEQ ID NO: 7182 - DNA, 15 bp, Homo sapiens
gggtacaagggcaaa

SEQ ID NO: 7183 - DNA, 15 bp, Homo sapiens
ggggtacaagggcaa

SEQ ID NO: 7184 - DNA, 15 bp, Homo sapiens
tggggtacaagggca

SEQ ID NO: 7185 - DNA, 15 bp, Homo sapiens
ctggggtacaagggc

SEQ ID NO: 7186 - DNA, 15 bp, Homo sapiens
cctggggtacaaggg

SEQ ID NO: 7187 - DNA, 15 bp, Homo sapiens
gcctggggtacaagg

SEQ ID NO: 7188 - DNA, 15 bp, Homo sapiens
agcctggggtacaag

SEQ ID NO: 7189 - DNA, 15 bp, Homo sapiens
cagcctggggtacaa

SEQ ID NO: 7190 - DNA, 15 bp, Homo sapiens
ccagcctggggtaca

SEQ ID NO: 7191 - DNA, 15 bp, Homo sapiens
tccagcctggggtac

SEQ ID NO: 7192 - DNA, 15 bp, Homo sapiens
ctccagcctggggta

SEQ ID NO: 7193 - DNA, 15 bp, Homo sapiens
actccagcctggggt

SEQ ID NO: 7194 - DNA, 15 bp, Homo sapiens
cactccagcctgggg

SEQ ID NO: 7195 - DNA, 15 bp, Homo sapiens
acaccactgcactcc

SEQ ID NO: 7196 - DNA, 15 bp, Homo sapiens
cacaccactgcactc

SEQ ID NO: 7197 - DNA, 15 bp, Homo sapiens
tcacaccactgcact

SEQ ID NO: 7198 - DNA, 15 bp, Homo sapiens
atcacaccactgcac

SEQ ID NO: 7199 - DNA, 15 bp, Homo sapiens
gatcacaccactgca

SEQ ID NO: 7200 - DNA, 15 bp, Homo sapiens
agatcacaccactgc

SEQ ID NO: 7201 - DNA, 15 bp, Homo sapiens
gagatcacaccactg

SEQ ID NO: 7202 - DNA, 15 bp, Homo sapiens
tgagatcacaccact

SEQ ID NO: 7203 - DNA, 15 bp, Homo sapiens
ctgagatcacaccac

SEQ ID NO: 7204 - DNA, 15 bp, Homo sapiens
gctgagatcacacca

SEQ ID NO: 7205 - DNA, 15 bp, Homo sapiens
agctgagatcacacc

SEQ ID NO: 7206 - DNA, 15 bp, Homo sapiens
gagctgagatcacac

SEQ ID NO: 7207 - DNA, 15 bp, Homo sapiens
tgagctgagatcaca

SEQ ID NO: 7208 - DNA, 15 bp, Homo sapiens
gtgagctgagatcac

SEQ ID NO: 7209 - DNA, 15 bp, Homo sapiens
tgtgagctgagatca

SEQ ID NO: 7210 - DNA, 15 bp, Homo sapiens
ctgtgagctgagatc

SEQ ID NO: 7211 - DNA, 15 bp, Homo sapiens
gctgtgagctgagat

SEQ ID NO: 7212 - DNA, 15 bp, Homo sapiens
tgctgtgagctgaga

SEQ ID NO: 7213 - DNA, 15 bp, Homo sapiens
ttgctgtgagctgag

SEQ ID NO: 7214 - DNA, 15 bp, Homo sapiens
gttgctgtgagctga

SEQ ID NO: 7215 - DNA, 15 bp, Homo sapiens
ggttgctgtgagctg

SEQ ID NO: 7216 - DNA, 15 bp, Homo sapiens
aggttgctgtgagct

SEQ ID NO: 7217 - DNA, 15 bp, Homo sapiens
gaggttgctgtgagc

SEQ ID NO: 7218 - DNA, 15 bp, Homo sapiens
ggaggttgctgtgag

SEQ ID NO: 7219 - DNA, 15 bp, Homo sapiens
cggaggttgctgtga

SEQ ID NO: 7220 - DNA, 15 bp, Homo sapiens
gcggaggttgctgtg

SEQ ID NO: 7221 - DNA, 15 bp, Homo sapiens
ggcggaggttgctgt

SEQ ID NO: 7222 - DNA, 15 bp, Homo sapiens
aggcggaggttgctg

SEQ ID NO: 7223 - DNA, 15 bp, Homo sapiens
gaggcggaggttgct

SEQ ID NO: 7224 - DNA, 15 bp, Homo sapiens
aggaggcggaggttg

SEQ ID NO: 7225 - DNA, 15 bp, Homo sapiens
caggaggcggaggtt

SEQ ID NO: 7226 - DNA, 15 bp, Homo sapiens
ccaggaggcggaggt

SEQ ID NO: 7227 - DNA, 15 bp, Homo sapiens
cccaggaggcggagg

SEQ ID NO: 7228 - DNA, 15 bp, Homo sapiens
acccaggaggcggag

SEQ ID NO: 7229 - DNA, 15 bp, Homo sapiens
aacccaggaggcgga

SEQ ID NO: 7230 - DNA, 15 bp, Homo sapiens
gaacccaggaggcgg

SEQ ID NO: 7231 - DNA, 15 bp, Homo sapiens
tgaacccaggaggcg

SEQ ID NO: 7232 - DNA, 15 bp, Homo sapiens
ttgcttgaacccagg

SEQ ID NO: 7233 - DNA, 15 bp, Homo sapiens
attgcttgaacccag

SEQ ID NO: 7234 - DNA, 15 bp, Homo sapiens
aattgcttgaaccca

SEQ ID NO: 7235 - DNA, 15 bp, Homo sapiens
gaattgcttgaaccc

SEQ ID NO: 7236 - DNA, 15 bp, Homo sapiens
cagaattgcttgaac

SEQ ID NO: 7237 - DNA, 15 bp, Homo sapiens
gcagaattgcttgaa

SEQ ID NO: 7238 - DNA, 15 bp, Homo sapiens
ggcagaattgcttga

SEQ ID NO: 7239 - DNA, 15 bp, Homo sapiens
aggcagaattgcttg

SEQ ID NO: 7240 - DNA, 15 bp, Homo sapiens
gaggcagaattgctt

SEQ ID NO: 7241 - DNA, 15 bp, Homo sapiens
cgaggcagaattgct

SEQ ID NO: 7242 - DNA, 15 bp, Homo sapiens
ccgaggcagaattgc

SEQ ID NO: 7243 - DNA, 15 bp, Homo sapiens
gccgaggcagaattg

SEQ ID NO: 7244 - DNA, 15 bp, Homo sapiens
ggccgaggcagaatt

SEQ ID NO: 7245 - DNA, 15 bp, Homo sapiens
aggccgaggcagaat

SEQ ID NO: 7246 - DNA, 15 bp, Homo sapiens
gaggccgaggcagaa

SEQ ID NO: 7247 - DNA, 15 bp, Homo sapiens
ggaggccgaggcaga

SEQ ID NO: 7248 - DNA, 15 bp, Homo sapiens
gggaggccgaggcag

SEQ ID NO: 7249 - DNA, 15 bp, Homo sapiens
tgggaggccgaggca

SEQ ID NO: 7250 - DNA, 15 bp, Homo sapiens
cttgggaggccgagg

SEQ ID NO: 7251 - DNA, 15 bp, Homo sapiens
acttgggaggccgag

SEQ ID NO: 7252 - DNA, 15 bp, Homo sapiens
tacttgggaggccga

SEQ ID NO: 7253 - DNA, 15 bp, Homo sapiens
ctacttgggaggccg

SEQ ID NO: 7254 - DNA, 15 bp, Homo sapiens
gctacttgggaggcc

SEQ ID NO: 7255 - DNA, 15 bp, Homo sapiens
tcgcctgtaatccca

SEQ ID NO: 7256 - DNA, 15 bp, Homo sapiens
gtcgcctgtaatccc

SEQ ID NO: 7257 - DNA, 15 bp, Homo sapiens
agtcgcctgtaatcc

SEQ ID NO: 7258 - DNA, 15 bp, Homo sapiens
cagtcgcctgtaatc

SEQ ID NO: 7259 - DNA, 15 bp, Homo sapiens
gcagtcgcctgtaat

SEQ ID NO: 7260 - DNA, 15 bp, Homo sapiens
ggcagtcgcctgtaa

SEQ ID NO: 7261 - DNA, 15 bp, Homo sapiens
tggcagtcgcctgta

SEQ ID NO: 7262 - DNA, 15 bp, Homo sapiens
gtggcagtcgcctgt

SEQ ID NO: 7263 - DNA, 15 bp, Homo sapiens
ggtggcagtcgcctg

SEQ ID NO: 7264 - DNA, 15 bp, Homo sapiens
tggtggcagtcgcct

SEQ ID NO: 7265 - DNA, 15 bp, Homo sapiens
gtggtggcagtcgcc

SEQ ID NO: 7266 - DNA, 15 bp, Homo sapiens
tgtggtggcagtcgc

SEQ ID NO: 7267 - DNA, 15 bp, Homo sapiens
gtgtggtggcagtcg

SEQ ID NO: 7268 - DNA, 15 bp, Homo sapiens
ggtgtggtggcagtc

SEQ ID NO: 7269 - DNA, 15 bp, Homo sapiens
gggtgtggtggcagt

SEQ ID NO: 7270 - DNA, 15 bp, Homo sapiens
cgggtgtggtggcag

SEQ ID NO: 7271 - DNA, 15 bp, Homo sapiens
ccgggtgtggtggca

SEQ ID NO: 7272 - DNA, 15 bp, Homo sapiens
caaaaattagccggg

SEQ ID NO: 7273 - DNA, 15 bp, Homo sapiens
aacaaaaattagccg

SEQ ID NO: 7274 - DNA, 15 bp, Homo sapiens
aaacaaaaattagcc

SEQ ID NO: 7275 - DNA, 15 bp, Homo sapiens
aaaacaaaaattagc

SEQ ID NO: 7276 - DNA, 15 bp, Homo sapiens
taaaacaaaaattag

SEQ ID NO: 7277 - DNA, 15 bp, Homo sapiens
ataaaacaaaaatta

SEQ ID NO: 7278 - DNA, 15 bp, Homo sapiens
aataaaacaaaaatt

SEQ ID NO: 7279 - DNA, 15 bp, Homo sapiens
taataaaacaaaaat

SEQ ID NO: 7280 - DNA, 15 bp, Homo sapiens
ctaataaaacaaaaa

SEQ ID NO: 7281 - DNA, 15 bp, Homo sapiens
actaataaaacaaaa

SEQ ID NO: 7282 - DNA, 15 bp, Homo sapiens
tactaataaaacaaa

SEQ ID NO: 7283 - DNA, 15 bp, Homo sapiens
ctactaataaaacaa

SEQ ID NO: 7284 - DNA, 15 bp, Homo sapiens
tctactaataaaaca

SEQ ID NO: 7285 - DNA, 15 bp, Homo sapiens
ctctactaataaaac

SEQ ID NO: 7286 - DNA, 15 bp, Homo sapiens
tctctactaataaaa

SEQ ID NO: 7287 - DNA, 15 bp, Homo sapiens
atctctactaataaa

SEQ ID NO: 7288 - DNA, 15 bp, Homo sapiens
catctctactaataa

SEQ ID NO: 7289 - DNA, 15 bp, Homo sapiens
ccatctctactaata

SEQ ID NO: 7290 - DNA, 15 bp, Homo sapiens
cccatctctactaat

SEQ ID NO: 7291 - DNA, 15 bp, Homo sapiens
tctggccaacatggt

SEQ ID NO: 7292 - DNA, 15 bp, Homo sapiens
gtctggccaacatgg

SEQ ID NO: 7293 - DNA, 15 bp, Homo sapiens
agtctggccaacatg

SEQ ID NO: 7294 - DNA, 15 bp, Homo sapiens
cagtctggccaacat

SEQ ID NO: 7295 - DNA, 15 bp, Homo sapiens
tcagtctggccaaca

SEQ ID NO: 7296 - DNA, 15 bp, Homo sapiens
atcagtctggccaac

SEQ ID NO: 7297 - DNA, 15 bp, Homo sapiens
gatcagtctggccaa

SEQ ID NO: 7298 - DNA, 15 bp, Homo sapiens
agatcagtctggcca

SEQ ID NO: 7299 - DNA, 15 bp, Homo sapiens
aagatcagtctggcc

SEQ ID NO: 7300 - DNA, 15 bp, Homo sapiens
caagatcagtctggc

SEQ ID NO: 7301 - DNA, 15 bp, Homo sapiens
tcaagatcagtctgg

SEQ ID NO: 7302 - DNA, 15 bp, Homo sapiens
ttcaagatcagtctg

SEQ ID NO: 7303 - DNA, 15 bp, Homo sapiens
gttcaagatcagtct

SEQ ID NO: 7304 - DNA, 15 bp, Homo sapiens
agttcaagatcagtc

SEQ ID NO: 7305 - DNA, 15 bp, Homo sapiens
gagttcaagatcagt

SEQ ID NO: 7306 - DNA, 15 bp, Homo sapiens
ggagttcaagatcag

SEQ ID NO: 7307 - DNA, 15 bp, Homo sapiens
aggagttcaagatca

SEQ ID NO: 7308 - DNA, 15 bp, Homo sapiens
caggagttcaagatc

SEQ ID NO: 7309 - DNA, 15 bp, Homo sapiens
tcaggagttcaagat

SEQ ID NO: 7310 - DNA, 15 bp, Homo sapiens
cgggtggatcacctg

SEQ ID NO: 7311 - DNA, 15 bp, Homo sapiens
gcgggtggatcacct

SEQ ID NO: 7312 - DNA, 15 bp, Homo sapiens
ggcgggtggatcacc

SEQ ID NO: 7313 - DNA, 15 bp, Homo sapiens
aggcgggtggatcac

SEQ ID NO: 7314 - DNA, 15 bp, Homo sapiens
gctttgggaggccaa

SEQ ID NO: 7315 - DNA, 15 bp, Homo sapiens
cgctttgggaggcca

SEQ ID NO: 7316 - DNA, 15 bp, Homo sapiens
cagcgctttgggagg

SEQ ID NO: 7317 - DNA, 15 bp, Homo sapiens
ccagcgctttgggag

SEQ ID NO: 7318 - DNA, 15 bp, Homo sapiens
cccagcgctttggga

SEQ ID NO: 7319 - DNA, 15 bp, Homo sapiens
tcccagcgctttggg

SEQ ID NO: 7320 - DNA, 15 bp, Homo sapiens
atcccagcgctttgg

SEQ ID NO: 7321 - DNA, 15 bp, Homo sapiens
aatcccagcgctttg

SEQ ID NO: 7322 - DNA, 15 bp, Homo sapiens
taatcccagcgcttt

SEQ ID NO: 7323 - DNA, 15 bp, Homo sapiens
gtaatcccagcgctt

SEQ ID NO: 7324 - DNA, 15 bp, Homo sapiens
tgtaatcccagcgct

SEQ ID NO: 7325 - DNA, 15 bp, Homo sapiens
ctgtaatcccagcgc

SEQ ID NO: 7326 - DNA, 15 bp, Homo sapiens
cctgtaatcccagcg

SEQ ID NO: 7327 - DNA, 15 bp, Homo sapiens
agctcacgcctgtaa

SEQ ID NO: 7328 - DNA, 15 bp, Homo sapiens
cagctcacgcctgta

SEQ ID NO: 7329 - DNA, 15 bp, Homo sapiens
gcagctcacgcctgt

SEQ ID NO: 7330 - DNA, 15 bp, Homo sapiens
ggcagctcacgcctg

SEQ ID NO: 7331 - DNA, 15 bp, Homo sapiens
cggcagctcacgcct

SEQ ID NO: 7332 - DNA, 15 bp, Homo sapiens
gcggcagctcacgcc

SEQ ID NO: 7333 - DNA, 15 bp, Homo sapiens
tgcggcagctcacgc

SEQ ID NO: 7334 - DNA, 15 bp, Homo sapiens
gtgcggcagctcacg

SEQ ID NO: 7335 - DNA, 15 bp, Homo sapiens
ggtgcggcagctcac

SEQ ID NO: 7336 - DNA, 15 bp, Homo sapiens
gggtgcggcagctca

SEQ ID NO: 7337 - DNA, 15 bp, Homo sapiens
tgggtgcggcagctc

SEQ ID NO: 7338 - DNA, 15 bp, Homo sapiens
ctgggtgcggcagct

SEQ ID NO: 7339 - DNA, 15 bp, Homo sapiens
gctgggtgcggcagc

SEQ ID NO: 7340 - DNA, 15 bp, Homo sapiens
agctgggtgcggcag

SEQ ID NO: 7341 - DNA, 15 bp, Homo sapiens
cagctgggtgcggca

SEQ ID NO: 7342 - DNA, 15 bp, Homo sapiens
acagctgggtgcggc

SEQ ID NO: 7343 - DNA, 15 bp, Homo sapiens
tacagctgggtgcgg

SEQ ID NO: 7344 - DNA, 15 bp, Homo sapiens
ttacagctgggtgcg

SEQ ID NO: 7345 - DNA, 15 bp, Homo sapiens
tttacagctgggtgc

SEQ ID NO: 7346 - DNA, 15 bp, Homo sapiens
gtttacagctgggtg

SEQ ID NO: 7347 - DNA, 15 bp, Homo sapiens
agtttacagctgggt

SEQ ID NO: 7348 - DNA, 15 bp, Homo sapiens
cagtttacagctggg

SEQ ID NO: 7349 - DNA, 15 bp, Homo sapiens
ccagtttacagctgg

SEQ ID NO: 7350 - DNA, 15 bp, Homo sapiens
tccagtttacagctg

SEQ ID NO: 7351 - DNA, 15 bp, Homo sapiens
atccagtttacagct

SEQ ID NO: 7352 - DNA, 15 bp, Homo sapiens
aatccagtttacagc

SEQ ID NO: 7353 - DNA, 15 bp, Homo sapiens
aaatccagtttacag

SEQ ID NO: 7354 - DNA, 15 bp, Homo sapiens
tagaaatccagttta

SEQ ID NO: 7355 - DNA, 15 bp, Homo sapiens
ttagaaatccagttt

SEQ ID NO: 7356 - DNA, 15 bp, Homo sapiens
attagaaatccagtt

SEQ ID NO: 7357 - DNA, 15 bp, Homo sapiens
cattagaaatccagt

SEQ ID NO: 7358 - DNA, 15 bp, Homo sapiens
ccattagaaatccag

SEQ ID NO: 7359 - DNA, 15 bp, Homo sapiens
accattagaaatcca

SEQ ID NO: 7360 - DNA, 15 bp, Homo sapiens
taccattagaaatcc

SEQ ID NO: 7361 - DNA, 15 bp, Homo sapiens
ctaccattagaaatc

SEQ ID NO: 7362 - DNA, 15 bp, Homo sapiens
tctaccattagaaat

SEQ ID NO: 7363 - DNA, 15 bp, Homo sapiens
atctaccattagaaa

SEQ ID NO: 7364 - DNA, 15 bp, Homo sapiens
aatctaccattagaa

SEQ ID NO: 7365 - DNA, 15 bp, Homo sapiens
aaatctaccattaga

SEQ ID NO: 7366 - DNA, 15 bp, Homo sapiens
aaaatctaccattag

SEQ ID NO: 7367 - DNA, 15 bp, Homo sapiens
aaaaatctaccatta

SEQ ID NO: 7368 - DNA, 15 bp, Homo sapiens
taaaaatctaccatt

SEQ ID NO: 7369 - DNA, 15 bp, Homo sapiens
ctaaaaatctaccat

SEQ ID NO: 7370 - DNA, 15 bp, Homo sapiens
cctaaaaatctacca

SEQ ID NO: 7371 - DNA, 15 bp, Homo sapiens
acctaaaaatctacc

SEQ ID NO: 7372 - DNA, 15 bp, Homo sapiens
tacctaaaaatctac

SEQ ID NO: 7373 - DNA, 15 bp, Homo sapiens
atacctaaaaatcta

SEQ ID NO: 7374 - DNA, 15 bp, Homo sapiens
aatacctaaaaatct

SEQ ID NO: 7375 - DNA, 15 bp, Homo sapiens
taatacctaaaaatc

SEQ ID NO: 7376 - DNA, 15 bp, Homo sapiens
ttaatacctaaaaat

SEQ ID NO: 7377 - DNA, 15 bp, Homo sapiens
gttaatacctaaaaa

SEQ ID NO: 7378 - DNA, 15 bp, Homo sapiens
tgttaatacctaaaa

SEQ ID NO: 7379 - DNA, 15 bp, Homo sapiens
ttgttaatacctaaa

SEQ ID NO: 7380 - DNA, 15 bp, Homo sapiens
attgttaatacctaa

SEQ ID NO: 7381 - DNA, 15 bp, Homo sapiens
tattgttaataccta

SEQ ID NO: 7382 - DNA, 15 bp, Homo sapiens
ctattgttaatacct

SEQ ID NO: 7383 - DNA, 15 bp, Homo sapiens
tctattgttaatacc

SEQ ID NO: 7384 - DNA, 15 bp, Homo sapiens
atctattgttaatac

SEQ ID NO: 7385 - DNA, 15 bp, Homo sapiens
tatctattgttaata

SEQ ID NO: 7386 - DNA, 15 bp, Homo sapiens
ttatctattgttaat

SEQ ID NO: 7387 - DNA, 15 bp, Homo sapiens
tttatctattgttaa

SEQ ID NO: 7388 - DNA, 15 bp, Homo sapiens
ttttatctattgtta

SEQ ID NO: 7389 - DNA, 15 bp, Homo sapiens
tttttatctattgtt

SEQ ID NO: 7390 - DNA, 15 bp, Homo sapiens
ctttttatctattgt

SEQ ID NO: 7391 - DNA, 15 bp, Homo sapiens
tctttttatctattg

SEQ ID NO: 7392 - DNA, 15 bp, Homo sapiens
atctttttatctatt

SEQ ID NO: 7393 - DNA, 15 bp, Homo sapiens
tatctttttatctat

SEQ ID NO: 7394 - DNA, 15 bp, Homo sapiens
gtatctttttatcta

SEQ ID NO: 7395 - DNA, 15 bp, Homo sapiens
agtatctttttatct

SEQ ID NO: 7396 - DNA, 15 bp, Homo sapiens
aagtatctttttatc

SEQ ID NO: 7397 - DNA, 15 bp, Homo sapiens
aaagtatctttttat

SEQ ID NO: 7398 - DNA, 15 bp, Homo sapiens
aaaagtatcttttta

SEQ ID NO: 7399 - DNA, 15 bp, Homo sapiens
aaaaagtatcttttt

SEQ ID NO: 7400 - DNA, 15 bp, Homo sapiens
caaaaagtatctttt

SEQ ID NO: 7401 - DNA, 15 bp, Homo sapiens
ccaaaaagtatcttt

SEQ ID NO: 7402 - DNA, 15 bp, Homo sapiens
gccaaaaagtatctt

SEQ ID NO: 7403 - DNA, 15 bp, Homo sapiens
tgccaaaaagtatct

SEQ ID NO: 7404 - DNA, 15 bp, Homo sapiens
atgccaaaaagtatc

SEQ ID NO: 7405 - DNA, 15 bp, Homo sapiens
tatgccaaaaagtat

SEQ ID NO: 7406 - DNA, 15 bp, Homo sapiens
gtatgccaaaaagta

SEQ ID NO: 7407 - DNA, 15 bp, Homo sapiens
agtatgccaaaaagt

SEQ ID NO: 7408 - DNA, 15 bp, Homo sapiens
cagtatgccaaaaag

SEQ ID NO: 7409 - DNA, 15 bp, Homo sapiens
acagtatgccaaaaa

SEQ ID NO: 7410 - DNA, 15 bp, Homo sapiens
cacagtatgccaaaa

SEQ ID NO: 7411 - DNA, 15 bp, Homo sapiens
acacagtatgccaaa

SEQ ID NO: 7412 - DNA, 15 bp, Homo sapiens
tacacagtatgccaa

SEQ ID NO: 7413 - DNA, 15 bp, Homo sapiens
atacacagtatgcca

SEQ ID NO: 7414 - DNA, 15 bp, Homo sapiens
aatacacagtatgcc

SEQ ID NO: 7415 - DNA, 15 bp, Homo sapiens
caatacacagtatgc

SEQ ID NO: 7416 - DNA, 15 bp, Homo sapiens
ccaatacacagtatg

SEQ ID NO: 7417 - DNA, 15 bp, Homo sapiens
cccaatacacagtat

SEQ ID NO: 7418 - DNA, 15 bp, Homo sapiens
tcccaatacacagta

SEQ ID NO: 7419 - DNA, 15 bp, Homo sapiens
atcccaatacacagt

SEQ ID NO: 7420 - DNA, 15 bp, Homo sapiens
catcccaatacacag

SEQ ID NO: 7421 - DNA, 15 bp, Homo sapiens
ccatcccaatacaca

SEQ ID NO: 7422 - DNA, 15 bp, Homo sapiens
cccatcccaatacac

SEQ ID NO: 7423 - DNA, 15 bp, Homo sapiens
ccccatcccaataca

SEQ ID NO: 7424 - DNA, 15 bp, Homo sapiens
accccatcccaatac

SEQ ID NO: 7425 - DNA, 15 bp, Homo sapiens
aaccccatcccaata

SEQ ID NO: 7426 - DNA, 15 bp, Homo sapiens
taaccccatcccaat

SEQ ID NO: 7427 - DNA, 15 bp, Homo sapiens
ctaaccccatcccaa

SEQ ID NO: 7428 - DNA, 15 bp, Homo sapiens
tctaaccccatccca

SEQ ID NO: 7429 - DNA, 15 bp, Homo sapiens
ttctaaccccatccc

SEQ ID NO: 7430 - DNA, 15 bp, Homo sapiens
gttctaaccccatcc

SEQ ID NO: 7431 - DNA, 15 bp, Homo sapiens
tgttctaaccccatc

SEQ ID NO: 7432 - DNA, 15 bp, Homo sapiens
ctgttctaaccccat

SEQ ID NO: 7433 - DNA, 15 bp, Homo sapiens
cctgttctaacccca

SEQ ID NO: 7434 - DNA, 15 bp, Homo sapiens
acctgttctaacccc

SEQ ID NO: 7435 - DNA, 15 bp, Homo sapiens
cacctgttctaaccc

SEQ ID NO: 7436 - DNA, 15 bp, Homo sapiens
acacctgttctaacc

SEQ ID NO: 7437 - DNA, 15 bp, Homo sapiens
aacacctgttctaac

SEQ ID NO: 7438 - DNA, 15 bp, Homo sapiens
gaacacctgttctaa

SEQ ID NO: 7439 - DNA, 15 bp, Homo sapiens
agaacacctgttcta

SEQ ID NO: 7440 - DNA, 15 bp, Homo sapiens
tagaacacctgttct

SEQ ID NO: 7441 - DNA, 15 bp, Homo sapiens
gtagaacacctgttc

SEQ ID NO: 7442 - DNA, 15 bp, Homo sapiens
ggtagaacacctgtt

SEQ ID NO: 7443 - DNA, 15 bp, Homo sapiens
gggtagaacacctgt

SEQ ID NO: 7444 - DNA, 15 bp, Homo sapiens
tgggtagaacacctg

SEQ ID NO: 7445 - DNA, 15 bp, Homo sapiens
ttgggtagaacacct

SEQ ID NO: 7446 - DNA, 15 bp, Homo sapiens
cttgggtagaacacc

SEQ ID NO: 7447 - DNA, 15 bp, Homo sapiens
tcttgggtagaacac

SEQ ID NO: 7448 - DNA, 15 bp, Homo sapiens
gtcttgggtagaaca

SEQ ID NO: 7449 - DNA, 15 bp, Homo sapiens
tgtcttgggtagaac

SEQ ID NO: 7450 - DNA, 15 bp, Homo sapiens
atgtcttgggtagaa

SEQ ID NO: 7451 - DNA, 15 bp, Homo sapiens
aatgtcttgggtaga

SEQ ID NO: 7452 - DNA, 15 bp, Homo sapiens
aaatgtcttgggtag

SEQ ID NO: 7453 - DNA, 15 bp, Homo sapiens
taaatgtcttgggta

SEQ ID NO: 7454 - DNA, 15 bp, Homo sapiens
gtaaatgtcttgggt

SEQ ID NO: 7455 - DNA, 15 bp, Homo sapiens
agtaaatgtcttggg

SEQ ID NO: 7456 - DNA, 15 bp, Homo sapiens
aagtaaatgtcttgg

SEQ ID NO: 7457 - DNA, 15 bp, Homo sapiens
taagtaaatgtcttg

SEQ ID NO: 7458 - DNA, 15 bp, Homo sapiens
ttaagtaaatgtctt

SEQ ID NO: 7459 - DNA, 15 bp, Homo sapiens
tttaagtaaatgtct

SEQ ID NO: 7460 - DNA, 15 bp, Homo sapiens
ttttaagtaaatgtc

SEQ ID NO: 7461 - DNA, 15 bp, Homo sapiens
attttaagtaaatgt

SEQ ID NO: 7462 - DNA, 15 bp, Homo sapiens
gattttaagtaaatg

SEQ ID NO: 7463 - DNA, 15 bp, Homo sapiens
cgattttaagtaaat

SEQ ID NO: 7464 - DNA, 15 bp, Homo sapiens
gcgattttaagtaaa

SEQ ID NO: 7465 - DNA, 15 bp, Homo sapiens
ggcgattttaagtaa

SEQ ID NO: 7466 - DNA, 15 bp, Homo sapiens
gggcgattttaagta

SEQ ID NO: 7467 - DNA, 15 bp, Homo sapiens
agggcgattttaagt

SEQ ID NO: 7468 - DNA, 15 bp, Homo sapiens
gagggcgattttaag

SEQ ID NO: 7469 - DNA, 15 bp, Homo sapiens
cgagggcgattttaa

SEQ ID NO: 7470 - DNA, 15 bp, Homo sapiens
tcgagggcgatttta

SEQ ID NO: 7471 - DNA, 15 bp, Homo sapiens
ttcgagggcgatttt

SEQ ID NO: 7472 - DNA, 15 bp, Homo sapiens
tttcgagggcgattt

SEQ ID NO: 7473 - DNA, 15 bp, Homo sapiens
atttcgagggcgatt

SEQ ID NO: 7474 - DNA, 15 bp, Homo sapiens
catttcgagggcgat

SEQ ID NO: 7475 - DNA, 15 bp, Homo sapiens
gcatttcgagggcga

SEQ ID NO: 7476 - DNA, 15 bp, Homo sapiens
agcatttcgagggcg

SEQ ID NO: 7477 - DNA, 15 bp, Homo sapiens
tagcatttcgagggc

SEQ ID NO: 7478 - DNA, 15 bp, Homo sapiens
atagcatttcgaggg

SEQ ID NO: 7479 - DNA, 15 bp, Homo sapiens
catagcatttcgagg

SEQ ID NO: 7480 - DNA, 15 bp, Homo sapiens
acatagcatttcgag

SEQ ID NO: 7481 - DNA, 15 bp, Homo sapiens
cacatagcatttcga

SEQ ID NO: 7482 - DNA, 15 bp, Homo sapiens
tcacatagcatttcg

SEQ ID NO: 7483 - DNA, 15 bp, Homo sapiens
ctcacatagcatttc

SEQ ID NO: 7484 - DNA, 15 bp, Homo sapiens
gctcacatagcattt

SEQ ID NO: 7485 - DNA, 15 bp, Homo sapiens
agctcacatagcatt

SEQ ID NO: 7486 - DNA, 15 bp, Homo sapiens
cagctcacatagcat

SEQ ID NO: 7487 - DNA, 15 bp, Homo sapiens
acagctcacatagca

SEQ ID NO: 7488 - DNA, 15 bp, Homo sapiens
cacagctcacatagc

SEQ ID NO: 7489 - DNA, 15 bp, Homo sapiens
acacagctcacatag

SEQ ID NO: 7490 - DNA, 15 bp, Homo sapiens
cacacagctcacata

SEQ ID NO: 7491 - DNA, 15 bp, Homo sapiens
acacacagctcacat

SEQ ID NO: 7492 - DNA, 15 bp, Homo sapiens
cacacacagctcaca

SEQ ID NO: 7493 - DNA, 15 bp, Homo sapiens
acacacacagctcac

SEQ ID NO: 7494 - DNA, 15 bp, Homo sapiens
cacacacacagctca

SEQ ID NO: 7495 - DNA, 15 bp, Homo sapiens
acacacacacagctc

SEQ ID NO: 7496 - DNA, 15 bp, Homo sapiens
cacacacacacagct

SEQ ID NO: 7497 - DNA, 15 bp, Homo sapiens
acacacacacacagc

SEQ ID NO: 7498 - DNA, 15 bp, Homo sapiens
cacacacacacacag

SEQ ID NO: 7499 - DNA, 15 bp, Homo sapiens
acacacacacacaca

SEQ ID NO: 7500 - DNA, 15 bp, Homo sapiens
cacacacacacacac

SEQ ID NO: 7501 - DNA, 15 bp, Homo sapiens
tacacacacacacac

SEQ ID NO: 7502 - DNA, 15 bp, Homo sapiens
atacacacacacaca

SEQ ID NO: 7503 - DNA, 15 bp, Homo sapiens
aatacacacacacac

SEQ ID NO: 7504 - DNA, 15 bp, Homo sapiens
taatacacacacaca

SEQ ID NO: 7505 - DNA, 15 bp, Homo sapiens
ttaatacacacacac

SEQ ID NO: 7506 - DNA, 15 bp, Homo sapiens
cttaatacacacaca

SEQ ID NO: 7507 - DNA, 15 bp, Homo sapiens
ccttaatacacacac

SEQ ID NO: 7508 - DNA, 15 bp, Homo sapiens
tccttaatacacaca

SEQ ID NO: 7509 - DNA, 15 bp, Homo sapiens
ttccttaatacacac

SEQ ID NO: 7510 - DNA, 15 bp, Homo sapiens
tttccttaatacaca

SEQ ID NO: 7511 - DNA, 15 bp, Homo sapiens
ttttccttaatacac

SEQ ID NO: 7512 - DNA, 15 bp, Homo sapiens
cttttccttaataca

SEQ ID NO: 7513 - DNA, 15 bp, Homo sapiens
gcttttccttaatac

SEQ ID NO: 7514 - DNA, 15 bp, Homo sapiens
tgcttttccttaata

SEQ ID NO: 7515 - DNA, 15 bp, Homo sapiens
atgcttttccttaat

SEQ ID NO: 7516 - DNA, 15 bp, Homo sapiens
catgcttttccttaa

SEQ ID NO: 7517 - DNA, 15 bp, Homo sapiens
tcatgcttttcctta

SEQ ID NO: 7518 - DNA, 15 bp, Homo sapiens
ttcatgcttttcctt

SEQ ID NO: 7519 - DNA, 15 bp, Homo sapiens
tttcatgcttttcct

SEQ ID NO: 7520 - DNA, 15 bp, Homo sapiens
ctttcatgcttttcc

SEQ ID NO: 7521 - DNA, 15 bp, Homo sapiens
actttcatgcttttc

SEQ ID NO: 7522 - DNA, 15 bp, Homo sapiens
tactttcatgctttt

SEQ ID NO: 7523 - DNA, 15 bp, Homo sapiens
atactttcatgcttt

SEQ ID NO: 7524 - DNA, 15 bp, Homo sapiens
aatactttcatgctt

SEQ ID NO: 7525 - DNA, 15 bp, Homo sapiens
aaatactttcatgct

SEQ ID NO: 7526 - DNA, 15 bp, Homo sapiens
taaatactttcatgc

SEQ ID NO: 7527 - DNA, 15 bp, Homo sapiens
ataaatactttcatg

SEQ ID NO: 7528 - DNA, 15 bp, Homo sapiens
cataaatactttcat

SEQ ID NO: 7529 - DNA, 15 bp, Homo sapiens
gcataaatactttca

SEQ ID NO: 7530 - DNA, 15 bp, Homo sapiens
agcataaatactttc

SEQ ID NO: 7531 - DNA, 15 bp, Homo sapiens
aagcataaatacttt

SEQ ID NO: 7532 - DNA, 15 bp, Homo sapiens
caagcataaatactt

SEQ ID NO: 7533 - DNA, 15 bp, Homo sapiens
tcaagcataaatact

SEQ ID NO: 7534 - DNA, 15 bp, Homo sapiens
atcaagcataaatac

SEQ ID NO: 7535 - DNA, 15 bp, Homo sapiens
aatcaagcataaata

SEQ ID NO: 7536 - DNA, 15 bp, Homo sapiens
aaatcaagcataaat

SEQ ID NO: 7537 - DNA, 15 bp, Homo sapiens
aaaatcaagcataaa

SEQ ID NO: 7538 - DNA, 15 bp, Homo sapiens
aaaaatcaagcataa

SEQ ID NO: 7539 - DNA, 15 bp, Homo sapiens
aaaaaatcaagcata

SEQ ID NO: 7540 - DNA, 15 bp, Homo sapiens
aaaaaaatcaagcat

SEQ ID NO: 7541 - DNA, 15 bp, Homo sapiens
aaaaaaaatcaagca

SEQ ID NO: 7542 - DNA, 15 bp, Homo sapiens
aaaaaaaaatcaagc

SEQ ID NO: 7543 - DNA, 15 bp, Homo sapiens
aaaaaaaaaatcaag

SEQ ID NO: 7544 - DNA, 15 bp, Homo sapiens
aaaaaaaaaaatcaa

SEQ ID NO: 7545 - DNA, 15 bp, Homo sapiens
aaaaaaaaaaaatca

SEQ ID NO: 7546 - DNA, 15 bp, Homo sapiens
taaaaaaaaaaaatc

SEQ ID NO: 7547 - DNA, 15 bp, Homo sapiens
gtaaaaaaaaaaaat

SEQ ID NO: 7548 - DNA, 15 bp, Homo sapiens
agtaaaaaaaaaaaa

SEQ ID NO: 7549 - DNA, 15 bp, Homo sapiens
gagtaaaaaaaaaaa

SEQ ID NO: 7550 - DNA, 15 bp, Homo sapiens
tgagtaaaaaaaaaa

SEQ ID NO: 7551 - DNA, 15 bp, Homo sapiens
atgagtaaaaaaaaa

SEQ ID NO: 7552 - DNA, 15 bp, Homo sapiens
tatgagtaaaaaaaa

SEQ ID NO: 7553 - DNA, 15 bp, Homo sapiens
ctatgagtaaaaaaa

SEQ ID NO: 7554 - DNA, 15 bp, Homo sapiens
gctatgagtaaaaaa

SEQ ID NO: 7555 - DNA, 15 bp, Homo sapiens
agctatgagtaaaaa

SEQ ID NO: 7556 - DNA, 15 bp, Homo sapiens
aagctatgagtaaaa

SEQ ID NO: 7557 - DNA, 15 bp, Homo sapiens
gaagctatgagtaaa

SEQ ID NO: 7558 - DNA, 15 bp, Homo sapiens
tgaagctatgagtaa

SEQ ID NO: 7559 - DNA, 15 bp, Homo sapiens
atgaagctatgagta

SEQ ID NO: 7560 - DNA, 15 bp, Homo sapiens
tatgaagctatgagt

SEQ ID NO: 7561 - DNA, 15 bp, Homo sapiens
ctatgaagctatgag

SEQ ID NO: 7562 - DNA, 15 bp, Homo sapiens
actatgaagctatga

SEQ ID NO: 7563 - DNA, 15 bp, Homo sapiens
cactatgaagctatg

SEQ ID NO: 7564 - DNA, 15 bp, Homo sapiens
ccactatgaagctat

SEQ ID NO: 7565 - DNA, 15 bp, Homo sapiens
tccactatgaagcta

SEQ ID NO: 7566 - DNA, 15 bp, Homo sapiens
ttccactatgaagct

SEQ ID NO: 7567 - DNA, 15 bp, Homo sapiens
gttccactatgaagc

SEQ ID NO: 7568 - DNA, 15 bp, Homo sapiens
tgttccactatgaag

SEQ ID NO: 7569 - DNA, 15 bp, Homo sapiens
ctgttccactatgaa

SEQ ID NO: 7570 - DNA, 15 bp, Homo sapiens
tctgttccactatga

SEQ ID NO: 7571 - DNA, 15 bp, Homo sapiens
atctgttccactatg

SEQ ID NO: 7572 - DNA, 15 bp, Homo sapiens
tatctgttccactat

SEQ ID NO: 7573 - DNA, 15 bp, Homo sapiens
gtatctgttccacta

SEQ ID NO: 7574 - DNA, 15 bp, Homo sapiens
tgtatctgttccact

SEQ ID NO: 7575 - DNA, 15 bp, Homo sapiens
atgtatctgttccac

SEQ ID NO: 7576 - DNA, 15 bp, Homo sapiens
tatgtatctgttcca

SEQ ID NO: 7577 - DNA, 15 bp, Homo sapiens
ctatgtatctgttcc

SEQ ID NO: 7578 - DNA, 15 bp, Homo sapiens
actatgtatctgttc

SEQ ID NO: 7579 - DNA, 15 bp, Homo sapiens
gactatgtatctgtt

SEQ ID NO: 7580 - DNA, 15 bp, Homo sapiens
agactatgtatctgt

SEQ ID NO: 7581 - DNA, 15 bp, Homo sapiens
tagactatgtatctg

SEQ ID NO: 7582 - DNA, 15 bp, Homo sapiens
ttagactatgtatct

SEQ ID NO: 7583 - DNA, 15 bp, Homo sapiens
tttagactatgtatc

SEQ ID NO: 7584 - DNA, 15 bp, Homo sapiens
atttagactatgtat

SEQ ID NO: 7585 - DNA, 15 bp, Homo sapiens
gatttagactatgta

SEQ ID NO: 7586 - DNA, 15 bp, Homo sapiens
tgatttagactatgt

SEQ ID NO: 7587 - DNA, 15 bp, Homo sapiens
ttgatttagactatg

SEQ ID NO: 7588 - DNA, 15 bp, Homo sapiens
tttgatttagactat

SEQ ID NO: 7589 - DNA, 15 bp, Homo sapiens
ttttgatttagacta

SEQ ID NO: 7590 - DNA, 15 bp, Homo sapiens
attttgatttagact

SEQ ID NO: 7591 - DNA, 15 bp, Homo sapiens
cattttgatttagac

SEQ ID NO: 7592 - DNA, 15 bp, Homo sapiens
acattttgatttaga

SEQ ID NO: 7593 - DNA, 15 bp, Homo sapiens
aacattttgatttag

SEQ ID NO: 7594 - DNA, 15 bp, Homo sapiens
aaacattttgattta

SEQ ID NO: 7595 - DNA, 15 bp, Homo sapiens
taaacattttgattt

SEQ ID NO: 7596 - DNA, 15 bp, Homo sapiens
ttaaacattttgatt

SEQ ID NO: 7597 - DNA, 15 bp, Homo sapiens
tttaaacattttgat

SEQ ID NO: 7598 - DNA, 15 bp, Homo sapiens
gtttaaacattttga

SEQ ID NO: 7599 - DNA, 15 bp, Homo sapiens
agtttaaacattttg

SEQ ID NO: 7600 - DNA, 15 bp, Homo sapiens
aagtttaaacatttt

SEQ ID NO: 7601 - DNA, 15 bp, Homo sapiens
aaagtttaaacattt

SEQ ID NO: 7602 - DNA, 15 bp, Homo sapiens
aaaagtttaaacatt

SEQ ID NO: 7603 - DNA, 15 bp, Homo sapiens
aaaaagtttaaacat

SEQ ID NO: 7604 - DNA, 15 bp, Homo sapiens
taaaaagtttaaaca

SEQ ID NO: 7605 - DNA, 15 bp, Homo sapiens
ataaaaagtttaaac

SEQ ID NO: 7606 - DNA, 15 bp, Homo sapiens
cataaaaagtttaaa

SEQ ID NO: 7607 - DNA, 15 bp, Homo sapiens
acataaaaagtttaa

SEQ ID NO: 7608 - DNA, 15 bp, Homo sapiens
gacataaaaagttta

SEQ ID NO: 7609 - DNA, 15 bp, Homo sapiens
tgacataaaaagttt

SEQ ID NO: 7610 - DNA, 15 bp, Homo sapiens
gtgacataaaaagtt

SEQ ID NO: 7611 - DNA, 15 bp, Homo sapiens
agtgacataaaaagt

SEQ ID NO: 7612 - DNA, 15 bp, Homo sapiens
aagtgacataaaaag

SEQ ID NO: 7613 - DNA, 15 bp, Homo sapiens
gcaagtgacataaaa

SEQ ID NO: 7614 - DNA, 15 bp, Homo sapiens
agcaagtgacataaa

SEQ ID NO: 7615 - DNA, 15 bp, Homo sapiens
cagcaagtgacataa

SEQ ID NO: 7616 - DNA, 15 bp, Homo sapiens
acagcaagtgacata

SEQ ID NO: 7617 - DNA, 15 bp, Homo sapiens
gacagcaagtgacat

SEQ ID NO: 7618 - DNA, 15 bp, Homo sapiens
agacagcaagtgaca

SEQ ID NO: 7619 - DNA, 15 bp, Homo sapiens
aagacagcaagtgac

SEQ ID NO: 7620 - DNA, 15 bp, Homo sapiens
aaagacagcaagtga

SEQ ID NO: 7621 - DNA, 15 bp, Homo sapiens
aaaagacagcaagtg

SEQ ID NO: 7622 - DNA, 15 bp, Homo sapiens
gaaaagacagcaagt

SEQ ID NO: 7623 - DNA, 15 bp, Homo sapiens
cgaaaagacagcaag

SEQ ID NO: 7624 - DNA, 15 bp, Homo sapiens
acgaaaagacagcaa

SEQ ID NO: 7625 - DNA, 15 bp, Homo sapiens
gacgaaaagacagca

SEQ ID NO: 7626 - DNA, 15 bp, Homo sapiens
ggacgaaaagacagc

SEQ ID NO: 7627 - DNA, 15 bp, Homo sapiens
aggacgaaaagacag

SEQ ID NO: 7628 - DNA, 15 bp, Homo sapiens
gaggacgaaaagaca

SEQ ID NO: 7629 - DNA, 15 bp, Homo sapiens
cgaggacgaaaagac

SEQ ID NO: 7630 - DNA, 15 bp, Homo sapiens
acgaggacgaaaaga

SEQ ID NO: 7631 - DNA, 15 bp, Homo sapiens
aacgaggacgaaaag

SEQ ID NO: 7632 - DNA, 15 bp, Homo sapiens
taacgaggacgaaaa

SEQ ID NO: 7633 - DNA, 15 bp, Homo sapiens
ttaacgaggacgaaa

SEQ ID NO: 7634 - DNA, 15 bp, Homo sapiens
tttaacgaggacgaa

SEQ ID NO: 7635 - DNA, 15 bp, Homo sapiens
atttaacgaggacga

SEQ ID NO: 7636 - DNA, 15 bp, Homo sapiens
aatttaacgaggacg

SEQ ID NO: 7637 - DNA, 15 bp, Homo sapiens
aaatttaacgaggac

SEQ ID NO: 7638 - DNA, 15 bp, Homo sapiens
taaatttaacgagga

SEQ ID NO: 7639 - DNA, 15 bp, Homo sapiens
ttaaatttaacgagg

SEQ ID NO: 7640 - DNA, 15 bp, Homo sapiens
attaaatttaacgag

SEQ ID NO: 7641 - DNA, 15 bp, Homo sapiens
aattaaatttaacga

SEQ ID NO: 7642 - DNA, 15 bp, Homo sapiens
aaattaaatttaacg

SEQ ID NO: 7643 - DNA, 15 bp, Homo sapiens
aaaattaaatttaac

SEQ ID NO: 7644 - DNA, 15 bp, Homo sapiens
caaaattaaatttaa

SEQ ID NO: 7645 - DNA, 15 bp, Homo sapiens
acaaaattaaattta

SEQ ID NO: 7646 - DNA, 15 bp, Homo sapiens
aacaaaattaaattt

SEQ ID NO: 7647 - DNA, 15 bp, Homo sapiens
caacaaaattaaatt

SEQ ID NO: 7648 - DNA, 15 bp, Homo sapiens
ccaacaaaattaaat

SEQ ID NO: 7649 - DNA, 15 bp, Homo sapiens
accaacaaaattaaa

SEQ ID NO: 7650 - DNA, 15 bp, Homo sapiens
gaccaacaaaattaa

SEQ ID NO: 7651 - DNA, 15 bp, Homo sapiens
agaccaacaaaatta

SEQ ID NO: 7652 - DNA, 15 bp, Homo sapiens
aagaccaacaaaatt

SEQ ID NO: 7653 - DNA, 15 bp, Homo sapiens
aaagaccaacaaaat

SEQ ID NO: 7654 - DNA, 15 bp, Homo sapiens
aaaagaccaacaaaa

SEQ ID NO: 7655 - DNA, 15 bp, Homo sapiens
caaaagaccaacaaa

SEQ ID NO: 7656 - DNA, 15 bp, Homo sapiens
acaaaagaccaacaa

SEQ ID NO: 7657 - DNA, 15 bp, Homo sapiens
aacaaaagaccaaca

SEQ ID NO: 7658 - DNA, 15 bp, Homo sapiens
caacaaaagaccaac

SEQ ID NO: 7659 - DNA, 15 bp, Homo sapiens
acaacaaaagaccaa

SEQ ID NO: 7660 - DNA, 15 bp, Homo sapiens
aacaacaaaagacca

SEQ ID NO: 7661 - DNA, 15 bp, Homo sapiens
taacaacaaaagacc

SEQ ID NO: 7662 - DNA, 15 bp, Homo sapiens
ataacaacaaaagac

SEQ ID NO: 7663 - DNA, 15 bp, Homo sapiens
aataacaacaaaaga

SEQ ID NO: 7664 - DNA, 15 bp, Homo sapiens
caataacaacaaaag

SEQ ID NO: 7665 - DNA, 15 bp, Homo sapiens
ccaataacaacaaaa

SEQ ID NO: 7666 - DNA, 15 bp, Homo sapiens
accaataacaacaaa

SEQ ID NO: 7667 - DNA, 15 bp, Homo sapiens
aaccaataacaacaa

SEQ ID NO: 7668 - DNA, 15 bp, Homo sapiens
caaccaataacaaca

SEQ ID NO: 7669 - DNA, 15 bp, Homo sapiens
ccaaccaataacaac

SEQ ID NO: 7670 - DNA, 15 bp, Homo sapiens
accaaccaataacaa

SEQ ID NO: 7671 - DNA, 15 bp, Homo sapiens
aaccaaccaataaca

SEQ ID NO: 7672 - DNA, 15 bp, Homo sapiens
aaaccaaccaataac

SEQ ID NO: 7673 - DNA, 15 bp, Homo sapiens
aaaaccaaccaataa

SEQ ID NO: 7674 - DNA, 15 bp, Homo sapiens
gaaaaccaaccaata

SEQ ID NO: 7675 - DNA, 15 bp, Homo sapiens
agaaaaccaaccaat

SEQ ID NO: 7676 - DNA, 15 bp, Homo sapiens
gagaaaaccaaccaa

SEQ ID NO: 7677 - DNA, 15 bp, Homo sapiens
ggagaaaaccaacca

SEQ ID NO: 7678 - DNA, 15 bp, Homo sapiens
tggagaaaaccaacc

SEQ ID NO: 7679 - DNA, 15 bp, Homo sapiens
ttggagaaaaccaac

SEQ ID NO: 7680 - DNA, 15 bp, Homo sapiens
tttggagaaaaccaa

SEQ ID NO: 7681 - DNA, 15 bp, Homo sapiens
atttggagaaaacca

SEQ ID NO: 7682 - DNA, 15 bp, Homo sapiens
catttggagaaaacc

SEQ ID NO: 7683 - DNA, 15 bp, Homo sapiens
gcatttggagaaaac

SEQ ID NO: 7684 - DNA, 15 bp, Homo sapiens
agcatttggagaaaa

SEQ ID NO: 7685 - DNA, 15 bp, Homo sapiens
tagcatttggagaaa

SEQ ID NO: 7686 - DNA, 15 bp, Homo sapiens
ctagcatttggagaa

SEQ ID NO: 7687 - DNA, 15 bp, Homo sapiens
gctagcatttggaga

SEQ ID NO: 7688 - DNA, 15 bp, Homo sapiens
agctagcatttggag

SEQ ID NO: 7689 - DNA, 15 bp, Homo sapiens
tagctagcatttgga

SEQ ID NO: 7690 - DNA, 15 bp, Homo sapiens
atagctagcatttgg

SEQ ID NO: 7691 - DNA, 15 bp, Homo sapiens
catagctagcatttg

SEQ ID NO: 7692 - DNA, 15 bp, Homo sapiens
acatagctagcattt

SEQ ID NO: 7693 - DNA, 15 bp, Homo sapiens
aacatagctagcatt

SEQ ID NO: 7694 - DNA, 15 bp, Homo sapiens
taacatagctagcat

SEQ ID NO: 7695 - DNA, 15 bp, Homo sapiens
ttaacatagctagca

SEQ ID NO: 7696 - DNA, 15 bp, Homo sapiens
cttaacatagctagc

SEQ ID NO: 7697 - DNA, 15 bp, Homo sapiens
tcttaacatagctag

SEQ ID NO: 7698 - DNA, 15 bp, Homo sapiens
ttcttaacatagcta

SEQ ID NO: 7699 - DNA, 15 bp, Homo sapiens
tttcttaacatagct

SEQ ID NO: 7700 - DNA, 15 bp, Homo sapiens
atttcttaacatagc

SEQ ID NO: 7701 - DNA, 15 bp, Homo sapiens
aatttcttaacatag

SEQ ID NO: 7702 - DNA, 15 bp, Homo sapiens
aaatttcttaacata

SEQ ID NO: 7703 - DNA, 15 bp, Homo sapiens
taaatttcttaacat

SEQ ID NO: 7704 - DNA, 15 bp, Homo sapiens
ttaaatttcttaaca

SEQ ID NO: 7705 - DNA, 15 bp, Homo sapiens
cttaaatttcttaac

SEQ ID NO: 7706 - DNA, 15 bp, Homo sapiens
ccttaaatttcttaa

SEQ ID NO: 7707 - DNA, 15 bp, Homo sapiens
gccttaaatttctta

SEQ ID NO: 7708 - DNA, 15 bp, Homo sapiens
ggccttaaatttctt

SEQ ID NO: 7709 - DNA, 15 bp, Homo sapiens
tggccttaaatttct

SEQ ID NO: 7710 - DNA, 15 bp, Homo sapiens
ctggccttaaatttc

SEQ ID NO: 7711 - DNA, 15 bp, Homo sapiens
cctggccttaaattt

SEQ ID NO: 7712 - DNA, 15 bp, Homo sapiens
acctggccttaaatt

SEQ ID NO: 7713 - DNA, 15 bp, Homo sapiens
tacctggccttaaat

SEQ ID NO: 7714 - DNA, 15 bp, Homo sapiens
gtacctggccttaaa

SEQ ID NO: 7715 - DNA, 15 bp, Homo sapiens
tgtacctggccttaa

SEQ ID NO: 7716 - DNA, 15 bp, Homo sapiens
ctgtacctggcctta

SEQ ID NO: 7717 - DNA, 15 bp, Homo sapiens
actgtacctggcctt

SEQ ID NO: 7718 - DNA, 15 bp, Homo sapiens
cactgtacctggcct

SEQ ID NO: 7719 - DNA, 15 bp, Homo sapiens
ccactgtacctggcc

SEQ ID NO: 7720 - DNA, 15 bp, Homo sapiens
gccactgtacctggc

SEQ ID NO: 7721 - DNA, 15 bp, Homo sapiens
agccactgtacctgg

SEQ ID NO: 7722 - DNA, 15 bp, Homo sapiens
gagccactgtacctg

SEQ ID NO: 7723 - DNA, 15 bp, Homo sapiens
tgagccactgtacct

SEQ ID NO: 7724 - DNA, 15 bp, Homo sapiens
atgagccactgtacc

SEQ ID NO: 7725 - DNA, 15 bp, Homo sapiens
catgagccactgtac

SEQ ID NO: 7726 - DNA, 15 bp, Homo sapiens
gcatgagccactgta

SEQ ID NO: 7727 - DNA, 15 bp, Homo sapiens
ggcatgagccactgt

SEQ ID NO: 7728 - DNA, 15 bp, Homo sapiens
cgggattacaggcat

SEQ ID NO: 7729 - DNA, 15 bp, Homo sapiens
ccgggattacaggca

SEQ ID NO: 7730 - DNA, 15 bp, Homo sapiens
gccgggattacaggc

SEQ ID NO: 7731 - DNA, 15 bp, Homo sapiens
tgccgggattacagg

SEQ ID NO: 7732 - DNA, 15 bp, Homo sapiens
atgccgggattacag

SEQ ID NO: 7733 - DNA, 15 bp, Homo sapiens
aatgccgggattaca

SEQ ID NO: 7734 - DNA, 15 bp, Homo sapiens
aaatgccgggattac

SEQ ID NO: 7735 - DNA, 15 bp, Homo sapiens
aaaatgccgggatta

SEQ ID NO: 7736 - DNA, 15 bp, Homo sapiens
taaaatgccgggatt

SEQ ID NO: 7737 - DNA, 15 bp, Homo sapiens
ctaaaatgccgggat

SEQ ID NO: 7738 - DNA, 15 bp, Homo sapiens
tctaaaatgccggga

SEQ ID NO: 7739 - DNA, 15 bp, Homo sapiens
ttctaaaatgccggg

SEQ ID NO: 7740 - DNA, 15 bp, Homo sapiens
cttctaaaatgccgg

SEQ ID NO: 7741 - DNA, 15 bp, Homo sapiens
ccttctaaaatgccg

SEQ ID NO: 7742 - DNA, 15 bp, Homo sapiens
gccttctaaaatgcc

SEQ ID NO: 7743 - DNA, 15 bp, Homo sapiens
agccttctaaaatgc

SEQ ID NO: 7744 - DNA, 15 bp, Homo sapiens
cagccttctaaaatg

SEQ ID NO: 7745 - DNA, 15 bp, Homo sapiens
tcagccttctaaaat

SEQ ID NO: 7746 - DNA, 15 bp, Homo sapiens
ctcagccttctaaaa

SEQ ID NO: 7747 - DNA, 15 bp, Homo sapiens
cctcagccttctaaa

SEQ ID NO: 7748 - DNA, 15 bp, Homo sapiens
gcctcagccttctaa

SEQ ID NO: 7749 - DNA, 15 bp, Homo sapiens
tgcctcagccttcta

SEQ ID NO: 7750 - DNA, 15 bp, Homo sapiens
ctgcctcagccttct

SEQ ID NO: 7751 - DNA, 15 bp, Homo sapiens
cctgcctcagccttc

SEQ ID NO: 7752 - DNA, 15 bp, Homo sapiens
tcctgcctcagcctt

SEQ ID NO: 7753 - DNA, 15 bp, Homo sapiens
gatcctcctgcctca

SEQ ID NO: 7754 - DNA, 15 bp, Homo sapiens
tgatcctcctgcctc

SEQ ID NO: 7755 - DNA, 15 bp, Homo sapiens
gtgatcctcctgcct

SEQ ID NO: 7756 - DNA, 15 bp, Homo sapiens
agtgatcctcctgcc

SEQ ID NO: 7757 - DNA, 15 bp, Homo sapiens
aagtgatcctcctgc

SEQ ID NO: 7758 - DNA, 15 bp, Homo sapiens
caagtgatcctcctg

SEQ ID NO: 7759 - DNA, 15 bp, Homo sapiens
tcaagtgatcctcct

SEQ ID NO: 7760 - DNA, 15 bp, Homo sapiens
agctcaagtgatcct

SEQ ID NO: 7761 - DNA, 15 bp, Homo sapiens
gagctcaagtgatcc

SEQ ID NO: 7762 - DNA, 15 bp, Homo sapiens
tgagctcaagtgatc

SEQ ID NO: 7763 - DNA, 15 bp, Homo sapiens
ctgagctcaagtgat

SEQ ID NO: 7764 - DNA, 15 bp, Homo sapiens
cctgagctcaagtga

SEQ ID NO: 7765 - DNA, 15 bp, Homo sapiens
tcctgagctcaagtg

SEQ ID NO: 7766 - DNA, 15 bp, Homo sapiens
ctcctgagctcaagt

SEQ ID NO: 7767 - DNA, 15 bp, Homo sapiens
aaactcctgagctca

SEQ ID NO: 7768 - DNA, 15 bp, Homo sapiens
caaactcctgagctc

SEQ ID NO: 7769 - DNA, 15 bp, Homo sapiens
tcaaactcctgagct

SEQ ID NO: 7770 - DNA, 15 bp, Homo sapiens
ctcaaactcctgagc

SEQ ID NO: 7771 - DNA, 15 bp, Homo sapiens
tctcaaactcctgag

SEQ ID NO: 7772 - DNA, 15 bp, Homo sapiens
actggtctcaaactc

SEQ ID NO: 7773 - DNA, 15 bp, Homo sapiens
gactggtctcaaact

SEQ ID NO: 7774 - DNA, 15 bp, Homo sapiens
agactggtctcaaac

SEQ ID NO: 7775 - DNA, 15 bp, Homo sapiens
cagactggtctcaaa

SEQ ID NO: 7776 - DNA, 15 bp, Homo sapiens
ccagactggtctcaa

SEQ ID NO: 7777 - DNA, 15 bp, Homo sapiens
cccagactggtctca

SEQ ID NO: 7778 - DNA, 15 bp, Homo sapiens
gcccagactggtctc

SEQ ID NO: 7779 - DNA, 15 bp, Homo sapiens
tgcccagactggtct

SEQ ID NO: 7780 - DNA, 15 bp, Homo sapiens
ttgcccagactggtc

SEQ ID NO: 7781 - DNA, 15 bp, Homo sapiens
gttgcccagactggt

SEQ ID NO: 7782 - DNA, 15 bp, Homo sapiens
tgttgcccagactgg

SEQ ID NO: 7783 - DNA, 15 bp, Homo sapiens
atgttgcccagactg

SEQ ID NO: 7784 - DNA, 15 bp, Homo sapiens
tatgttgcccagact

SEQ ID NO: 7785 - DNA, 15 bp, Homo sapiens
ctatgttgcccagac

SEQ ID NO: 7786 - DNA, 15 bp, Homo sapiens
gctatgttgcccaga

SEQ ID NO: 7787 - DNA, 15 bp, Homo sapiens
tgctatgttgcccag

SEQ ID NO: 7788 - DNA, 15 bp, Homo sapiens
ttgctatgttgccca

SEQ ID NO: 7789 - DNA, 15 bp, Homo sapiens
cttgctatgttgccc

SEQ ID NO: 7790 - DNA, 15 bp, Homo sapiens
tcttgctatgttgcc

SEQ ID NO: 7791 - DNA, 15 bp, Homo sapiens
gtcttgctatgttgc

SEQ ID NO: 7792 - DNA, 15 bp, Homo sapiens
ggtcttgctatgttg

SEQ ID NO: 7793 - DNA, 15 bp, Homo sapiens
aggtcttgctatgtt

SEQ ID NO: 7794 - DNA, 15 bp, Homo sapiens
gaggtcttgctatgt

SEQ ID NO: 7795 - DNA, 15 bp, Homo sapiens
cgaggtcttgctatg

SEQ ID NO: 7796 - DNA, 15 bp, Homo sapiens
acgaggtcttgctat

SEQ ID NO: 7797 - DNA, 15 bp, Homo sapiens
gacgaggtcttgcta

SEQ ID NO: 7798 - DNA, 15 bp, Homo sapiens
agacgaggtcttgct

SEQ ID NO: 7799 - DNA, 15 bp, Homo sapiens
aagacgaggtcttgc

SEQ ID NO: 7800 - DNA, 15 bp, Homo sapiens
aaagacgaggtcttg

SEQ ID NO: 7801 - DNA, 15 bp, Homo sapiens
caaagacgaggtctt

SEQ ID NO: 7802 - DNA, 15 bp, Homo sapiens
acaaagacgaggtct

SEQ ID NO: 7803 - DNA, 15 bp, Homo sapiens
aacaaagacgaggtc

SEQ ID NO: 7804 - DNA, 15 bp, Homo sapiens
aaacaaagacgaggt

SEQ ID NO: 7805 - DNA, 15 bp, Homo sapiens
taaacaaagacgagg

SEQ ID NO: 7806 - DNA, 15 bp, Homo sapiens
ctaaacaaagacgag

SEQ ID NO: 7807 - DNA, 15 bp, Homo sapiens
cctaaacaaagacga

SEQ ID NO: 7808 - DNA, 15 bp, Homo sapiens
ccctaaacaaagacg

SEQ ID NO: 7809 - DNA, 15 bp, Homo sapiens
cccctaaacaaagac

SEQ ID NO: 7810 - DNA, 15 bp, Homo sapiens
tcccctaaacaaaga

SEQ ID NO: 7811 - DNA, 15 bp, Homo sapiens
ttcccctaaacaaag

SEQ ID NO: 7812 - DNA, 15 bp, Homo sapiens
tttcccctaaacaaa

SEQ ID NO: 7813 - DNA, 15 bp, Homo sapiens
ttttcccctaaacaa

SEQ ID NO: 7814 - DNA, 15 bp, Homo sapiens
tttttcccctaaaca

SEQ ID NO: 7815 - DNA, 15 bp, Homo sapiens
ttttttcccctaaac

SEQ ID NO: 7816 - DNA, 15 bp, Homo sapiens
tttttttcccctaaa

SEQ ID NO: 7817 - DNA, 15 bp, Homo sapiens
ttttttttcccctaa

SEQ ID NO: 7818 - DNA, 15 bp, Homo sapiens
cttttttttccccta

SEQ ID NO: 7819 - DNA, 15 bp, Homo sapiens
tcttttttttcccct

SEQ ID NO: 7820 - DNA, 15 bp, Homo sapiens
ttcttttttttcccc

SEQ ID NO: 7821 - DNA, 15 bp, Homo sapiens
tttcttttttttccc

SEQ ID NO: 7822 - DNA, 15 bp, Homo sapiens
atttcttttttttcc

SEQ ID NO: 7823 - DNA, 15 bp, Homo sapiens
aatttcttttttttc

SEQ ID NO: 7824 - DNA, 15 bp, Homo sapiens
aaatttctttttttt

SEQ ID NO: 7825 - DNA, 15 bp, Homo sapiens
taaatttcttttttt

SEQ ID NO: 7826 - DNA, 15 bp, Homo sapiens
ttaaatttctttttt

SEQ ID NO: 7827 - DNA, 15 bp, Homo sapiens
cttaaatttcttttt

SEQ ID NO: 7828 - DNA, 15 bp, Homo sapiens
acttaaatttctttt

SEQ ID NO: 7829 - DNA, 15 bp, Homo sapiens
tacttaaatttcttt

SEQ ID NO: 7830 - DNA, 15 bp, Homo sapiens
ctacttaaatttctt

SEQ ID NO: 7831 - DNA, 15 bp, Homo sapiens
cctacttaaatttct

SEQ ID NO: 7832 - DNA, 15 bp, Homo sapiens
tcctacttaaatttc

SEQ ID NO: 7833 - DNA, 15 bp, Homo sapiens
ctcctacttaaattt

SEQ ID NO: 7834 - DNA, 15 bp, Homo sapiens
tctcctacttaaatt

SEQ ID NO: 7835 - DNA, 15 bp, Homo sapiens
atctcctacttaaat

SEQ ID NO: 7836 - DNA, 15 bp, Homo sapiens
aatctcctacttaaa

SEQ ID NO: 7837 - DNA, 15 bp, Homo sapiens
taatctcctacttaa

SEQ ID NO: 7838 - DNA, 15 bp, Homo sapiens
ataatctcctactta

SEQ ID NO: 7839 - DNA, 15 bp, Homo sapiens
tataatctcctactt

SEQ ID NO: 7840 - DNA, 15 bp, Homo sapiens
atataatctcctact

SEQ ID NO: 7841 - DNA, 15 bp, Homo sapiens
tatataatctcctac

SEQ ID NO: 7842 - DNA, 15 bp, Homo sapiens
ttatataatctccta

SEQ ID NO: 7843 - DNA, 15 bp, Homo sapiens
cttatataatctcct

SEQ ID NO: 7844 - DNA, 15 bp, Homo sapiens
gcttatataatctcc

SEQ ID NO: 7845 - DNA, 15 bp, Homo sapiens
tgcttatataatctc

SEQ ID NO: 7846 - DNA, 15 bp, Homo sapiens
ttgcttatataatct

SEQ ID NO: 7847 - DNA, 15 bp, Homo sapiens
tttgcttatataatc

SEQ ID NO: 7848 - DNA, 15 bp, Homo sapiens
ttttgcttatataat

SEQ ID NO: 7849 - DNA, 15 bp, Homo sapiens
tttttgcttatataa

SEQ ID NO: 7850 - DNA, 15 bp, Homo sapiens
atttttgcttatata

SEQ ID NO: 7851 - DNA, 15 bp, Homo sapiens
tatttttgcttatat

SEQ ID NO: 7852 - DNA, 15 bp, Homo sapiens
gtatttttgcttata

SEQ ID NO: 7853 - DNA, 15 bp, Homo sapiens
tgtatttttgcttat

SEQ ID NO: 7854 - DNA, 15 bp, Homo sapiens
ttgtatttttgctta

SEQ ID NO: 7855 - DNA, 15 bp, Homo sapiens
attgtatttttgctt

SEQ ID NO: 7856 - DNA, 15 bp, Homo sapiens
aattgtatttttgct

SEQ ID NO: 7857 - DNA, 15 bp, Homo sapiens
taattgtatttttgc

SEQ ID NO: 7858 - DNA, 15 bp, Homo sapiens
ttaattgtatttttg

SEQ ID NO: 7859 - DNA, 15 bp, Homo sapiens
attaattgtattttt

SEQ ID NO: 7860 - DNA, 15 bp, Homo sapiens
aattaattgtatttt

SEQ ID NO: 7861 - DNA, 15 bp, Homo sapiens
aaattaattgtattt

SEQ ID NO: 7862 - DNA, 15 bp, Homo sapiens
gaaattaattgtatt

SEQ ID NO: 7863 - DNA, 15 bp, Homo sapiens
ggaaattaattgtat

SEQ ID NO: 7864 - DNA, 15 bp, Homo sapiens
tggaaattaattgta

SEQ ID NO: 7865 - DNA, 15 bp, Homo sapiens
ctggaaattaattgt

SEQ ID NO: 7866 - DNA, 15 bp, Homo sapiens
gctggaaattaattg

SEQ ID NO: 7867 - DNA, 15 bp, Homo sapiens
tgctggaaattaatt

SEQ ID NO: 7868 - DNA, 15 bp, Homo sapiens
atgctggaaattaat

SEQ ID NO: 7869 - DNA, 15 bp, Homo sapiens
aatgctggaaattaa

SEQ ID NO: 7870 - DNA, 15 bp, Homo sapiens
gaatgctggaaatta

SEQ ID NO: 7871 - DNA, 15 bp, Homo sapiens
tgaatgctggaaatt

SEQ ID NO: 7872 - DNA, 15 bp, Homo sapiens
gtgaatgctggaaat

SEQ ID NO: 7873 - DNA, 15 bp, Homo sapiens
agtgaatgctggaaa

SEQ ID NO: 7874 - DNA, 15 bp, Homo sapiens
tagtgaatgctggaa

SEQ ID NO: 7875 - DNA, 15 bp, Homo sapiens
atagtgaatgctgga

SEQ ID NO: 7876 - DNA, 15 bp, Homo sapiens
tatagtgaatgctgg

SEQ ID NO: 7877 - DNA, 15 bp, Homo sapiens
atatagtgaatgctg

SEQ ID NO: 7878 - DNA, 15 bp, Homo sapiens
tatatagtgaatgct

SEQ ID NO: 7879 - DNA, 15 bp, Homo sapiens
ttatatagtgaatgc

SEQ ID NO: 7880 - DNA, 15 bp, Homo sapiens
attatatagtgaatg

SEQ ID NO: 7881 - DNA, 15 bp, Homo sapiens
tattatatagtgaat

SEQ ID NO: 7882 - DNA, 15 bp, Homo sapiens
atattatatagtgaa

SEQ ID NO: 7883 - DNA, 15 bp, Homo sapiens
tatattatatagtga

SEQ ID NO: 7884 - DNA, 15 bp, Homo sapiens
ttatattatatagtg

SEQ ID NO: 7885 - DNA, 15 bp, Homo sapiens
tttatattatatagt

SEQ ID NO: 7886 - DNA, 15 bp, Homo sapiens
atttatattatatag

SEQ ID NO: 7887 - DNA, 15 bp, Homo sapiens
gatttatattatata

SEQ ID NO: 7888 - DNA, 15 bp, Homo sapiens
agatttatattatat

SEQ ID NO: 7889 - DNA, 15 bp, Homo sapiens
gagatttatattata

SEQ ID NO: 7890 - DNA, 15 bp, Homo sapiens
ggagatttatattat

SEQ ID NO: 7891 - DNA, 15 bp, Homo sapiens
tggagatttatatta

SEQ ID NO: 7892 - DNA, 15 bp, Homo sapiens
ctggagatttatatt

SEQ ID NO: 7893 - DNA, 15 bp, Homo sapiens
tctggagatttatat

SEQ ID NO: 7894 - DNA, 15 bp, Homo sapiens
gtctggagatttata

SEQ ID NO: 7895 - DNA, 15 bp, Homo sapiens
agtctggagatttat

SEQ ID NO: 7896 - DNA, 15 bp, Homo sapiens
aagtctggagattta

SEQ ID NO: 7897 - DNA, 15 bp, Homo sapiens
aaagtctggagattt

SEQ ID NO: 7898 - DNA, 15 bp, Homo sapiens
taaagtctggagatt

SEQ ID NO: 7899 - DNA, 15 bp, Homo sapiens
gtaaagtctggagat

SEQ ID NO: 7900 - DNA, 15 bp, Homo sapiens
agtaaagtctggaga

SEQ ID NO: 7901 - DNA, 15 bp, Homo sapiens
aagtaaagtctggag

SEQ ID NO: 7902 - DNA, 15 bp, Homo sapiens
aaagtaaagtctgga

SEQ ID NO: 7903 - DNA, 15 bp, Homo sapiens
aaaagtaaagtctgg

SEQ ID NO: 7904 - DNA, 15 bp, Homo sapiens
aaaaagtaaagtctg

SEQ ID NO: 7905 - DNA, 15 bp, Homo sapiens
aaaaaagtaaagtct

SEQ ID NO: 7906 - DNA, 15 bp, Homo sapiens
caaaaaagtaaagtc

SEQ ID NO: 7907 - DNA, 15 bp, Homo sapiens
acaaaaaagtaaagt

SEQ ID NO: 7908 - DNA, 15 bp, Homo sapiens
aacaaaaaagtaaag

SEQ ID NO: 7909 - DNA, 15 bp, Homo sapiens
aaacaaaaaagtaaa

SEQ ID NO: 7910 - DNA, 15 bp, Homo sapiens
taaacaaaaaagtaa

SEQ ID NO: 7911 - DNA, 15 bp, Homo sapiens
gtaaacaaaaaagta

SEQ ID NO: 7912 - DNA, 15 bp, Homo sapiens
agtaaacaaaaaagt

SEQ ID NO: 7913 - DNA, 15 bp, Homo sapiens
cagtaaacaaaaaag

SEQ ID NO: 7914 - DNA, 15 bp, Homo sapiens
ccagtaaacaaaaaa

SEQ ID NO: 7915 - DNA, 15 bp, Homo sapiens
tccagtaaacaaaaa

SEQ ID NO: 7916 - DNA, 15 bp, Homo sapiens
atccagtaaacaaaa

SEQ ID NO: 7917 - DNA, 15 bp, Homo sapiens
tatccagtaaacaaa

SEQ ID NO: 7918 - DNA, 15 bp, Homo sapiens
atatccagtaaacaa

SEQ ID NO: 7919 - DNA, 15 bp, Homo sapiens
tatatccagtaaaca

SEQ ID NO: 7920 - DNA, 15 bp, Homo sapiens
ttatatccagtaaac

SEQ ID NO: 7921 - DNA, 15 bp, Homo sapiens
tttatatccagtaaa

SEQ ID NO: 7922 - DNA, 15 bp, Homo sapiens
gtttatatccagtaa

SEQ ID NO: 7923 - DNA, 15 bp, Homo sapiens
tgtttatatccagta

SEQ ID NO: 7924 - DNA, 15 bp, Homo sapiens
ttgtttatatccagt

SEQ ID NO: 7925 - DNA, 15 bp, Homo sapiens
attgtttatatccag

SEQ ID NO: 7926 - DNA, 15 bp, Homo sapiens
tattgtttatatcca

SEQ ID NO: 7927 - DNA, 15 bp, Homo sapiens
atattgtttatatcc

SEQ ID NO: 7928 - DNA, 15 bp, Homo sapiens
gatattgtttatatc

SEQ ID NO: 7929 - DNA, 15 bp, Homo sapiens
agatattgtttatat

SEQ ID NO: 7930 - DNA, 15 bp, Homo sapiens
aagatattgtttata

SEQ ID NO: 7931 - DNA, 15 bp, Homo sapiens
aaagatattgtttat

SEQ ID NO: 7932 - DNA, 15 bp, Homo sapiens
aaaagatattgttta

SEQ ID NO: 7933 - DNA, 15 bp, Homo sapiens
aaaaagatattgttt

SEQ ID NO: 7934 - DNA, 15 bp, Homo sapiens
gaaaaagatattgtt

SEQ ID NO: 7935 - DNA, 15 bp, Homo sapiens
agaaaaagatattgt

SEQ ID NO: 7936 - DNA, 15 bp, Homo sapiens
cagaaaaagatattg

SEQ ID NO: 7937 - DNA, 15 bp, Homo sapiens
acagaaaaagatatt

SEQ ID NO: 7938 - DNA, 15 bp, Homo sapiens
gacagaaaaagatat

SEQ ID NO: 7939 - DNA, 15 bp, Homo sapiens
agacagaaaaagata

SEQ ID NO: 7940 - DNA, 15 bp, Homo sapiens
gagacagaaaaagat

SEQ ID NO: 7941 - DNA, 15 bp, Homo sapiens
ggagacagaaaaaga

SEQ ID NO: 7942 - DNA, 15 bp, Homo sapiens
tggagacagaaaaag

SEQ ID NO: 7943 - DNA, 15 bp, Homo sapiens
ctggagacagaaaaa

SEQ ID NO: 7944 - DNA, 15 bp, Homo sapiens
tctggagacagaaaa

SEQ ID NO: 7945 - DNA, 15 bp, Homo sapiens
atctggagacagaaa

SEQ ID NO: 7946 - DNA, 15 bp, Homo sapiens
tatctggagacagaa

SEQ ID NO: 7947 - DNA, 15 bp, Homo sapiens
ttatctggagacaga

SEQ ID NO: 7948 - DNA, 15 bp, Homo sapiens
attatctggagacag

SEQ ID NO: 7949 - DNA, 15 bp, Homo sapiens
aattatctggagaca

SEQ ID NO: 7950 - DNA, 15 bp, Homo sapiens
gaattatctggagac

SEQ ID NO: 7951 - DNA, 15 bp, Homo sapiens
ggaattatctggaga

SEQ ID NO: 7952 - DNA, 15 bp, Homo sapiens
gggaattatctggag

SEQ ID NO: 7953 - DNA, 15 bp, Homo sapiens
ggggaattatctgga

SEQ ID NO: 7954 - DNA, 15 bp, Homo sapiens
gggggaattatctgg

SEQ ID NO: 7955 - DNA, 15 bp, Homo sapiens
tgggggaattatctg

SEQ ID NO: 7956 - DNA, 15 bp, Homo sapiens
gtgggggaattatct

SEQ ID NO: 7957 - DNA, 15 bp, Homo sapiens
ggtgggggaattatc

SEQ ID NO: 7958 - DNA, 15 bp, Homo sapiens
tggtgggggaattat

SEQ ID NO: 7959 - DNA, 15 bp, Homo sapiens
gtggtgggggaatta

SEQ ID NO: 7960 - DNA, 15 bp, Homo sapiens
ggtggtgggggaatt

SEQ ID NO: 7961 - DNA, 15 bp, Homo sapiens
aggtggtgggggaat

SEQ ID NO: 7962 - DNA, 15 bp, Homo sapiens
gaggtggtgggggaa

SEQ ID NO: 7963 - DNA, 15 bp, Homo sapiens
ggaggtggtggggga

SEQ ID NO: 7964 - DNA, 15 bp, Homo sapiens
gggaggtggtggggg

SEQ ID NO: 7965 - DNA, 15 bp, Homo sapiens
tgggaggtggtgggg

SEQ ID NO: 7966 - DNA, 15 bp, Homo sapiens
atgggaggtggtggg

SEQ ID NO: 7967 - DNA, 15 bp, Homo sapiens
tatgggaggtggtgg

SEQ ID NO: 7968 - DNA, 15 bp, Homo sapiens
atatgggaggtggtg

SEQ ID NO: 7969 - DNA, 15 bp, Homo sapiens
catatgggaggtggt

SEQ ID NO: 7970 - DNA, 15 bp, Homo sapiens
acatatgggaggtgg

SEQ ID NO: 7971 - DNA, 15 bp, Homo sapiens
gacatatgggaggtg

SEQ ID NO: 7972 - DNA, 15 bp, Homo sapiens
ggacatatgggaggt

SEQ ID NO: 7973 - DNA, 15 bp, Homo sapiens
tggacatatgggagg

SEQ ID NO: 7974 - DNA, 15 bp, Homo sapiens
ctggacatatgggag

SEQ ID NO: 7975 - DNA, 15 bp, Homo sapiens
tctggacatatggga

SEQ ID NO: 7976 - DNA, 15 bp, Homo sapiens
atctggacatatggg

SEQ ID NO: 7977 - DNA, 15 bp, Homo sapiens
aatctggacatatgg

SEQ ID NO: 7978 - DNA, 15 bp, Homo sapiens
gaatctggacatatg

SEQ ID NO: 7979 - DNA, 15 bp, Homo sapiens
agaatctggacatat

SEQ ID NO: 7980 - DNA, 15 bp, Homo sapiens
gagaatctggacata

SEQ ID NO: 7981 - DNA, 15 bp, Homo sapiens
agagaatctggacat

SEQ ID NO: 7982 - DNA, 15 bp, Homo sapiens
aagagaatctggaca

SEQ ID NO: 7983 - DNA, 15 bp, Homo sapiens
caagagaatctggac

SEQ ID NO: 7984 - DNA, 15 bp, Homo sapiens
tcaagagaatctgga

SEQ ID NO: 7985 - DNA, 15 bp, Homo sapiens
atcaagagaatctgg

SEQ ID NO: 7986 - DNA, 15 bp, Homo sapiens
catcaagagaatctg

SEQ ID NO: 7987 - DNA, 15 bp, Homo sapiens
tcatcaagagaatct

SEQ ID NO: 7988 - DNA, 15 bp, Homo sapiens
atcatcaagagaatc

SEQ ID NO: 7989 - DNA, 15 bp, Homo sapiens
catcatcaagagaat

SEQ ID NO: 7990 - DNA, 15 bp, Homo sapiens
gcatcatcaagagaa

SEQ ID NO: 7991 - DNA, 15 bp, Homo sapiens
agcatcatcaagaga

SEQ ID NO: 7992 - DNA, 15 bp, Homo sapiens
cagcatcatcaagag

SEQ ID NO: 7993 - DNA, 15 bp, Homo sapiens
tcagcatcatcaaga

SEQ ID NO: 7994 - DNA, 15 bp, Homo sapiens
atcagcatcatcaag

SEQ ID NO: 7995 - DNA, 15 bp, Homo sapiens
catcagcatcatcaa

SEQ ID NO: 7996 - DNA, 15 bp, Homo sapiens
gcatcagcatcatca

SEQ ID NO: 7997 - DNA, 15 bp, Homo sapiens
agcatcagcatcatc

SEQ ID NO: 7998 - DNA, 15 bp, Homo sapiens
aagcatcagcatcat

SEQ ID NO: 7999 - DNA, 15 bp, Homo sapiens
aaagcatcagcatca

SEQ ID NO: 8000 - DNA, 15 bp, Homo sapiens
caaagcatcagcatc

SEQ ID NO: 8001 - DNA, 15 bp, Homo sapiens
ccaaagcatcagcat

SEQ ID NO: 8002 - DNA, 15 bp, Homo sapiens
cccaaagcatcagca

SEQ ID NO: 8003 - DNA, 15 bp, Homo sapiens
tcccaaagcatcagc

SEQ ID NO: 8004 - DNA, 15 bp, Homo sapiens
ttcccaaagcatcag

SEQ ID NO: 8005 - DNA, 15 bp, Homo sapiens
cttcccaaagcatca

SEQ ID NO: 8006 - DNA, 15 bp, Homo sapiens
acttcccaaagcatc

SEQ ID NO: 8007 - DNA, 15 bp, Homo sapiens
tacttcccaaagcat

SEQ ID NO: 8008 - DNA, 15 bp, Homo sapiens
atacttcccaaagca

SEQ ID NO: 8009 - DNA, 15 bp, Homo sapiens
catacttcccaaagc

SEQ ID NO: 8010 - DNA, 15 bp, Homo sapiens
acatacttcccaaag

SEQ ID NO: 8011 - DNA, 15 bp, Homo sapiens
aacatacttcccaaa

SEQ ID NO: 8012 - DNA, 15 bp, Homo sapiens
taacatacttcccaa

SEQ ID NO: 8013 - DNA, 15 bp, Homo sapiens
ttaacatacttccca

SEQ ID NO: 8014 - DNA, 15 bp, Homo sapiens
attaacatacttccc

SEQ ID NO: 8015 - DNA, 15 bp, Homo sapiens
aattaacatacttcc

SEQ ID NO: 8016 - DNA, 15 bp, Homo sapiens
aaattaacatacttc

SEQ ID NO: 8017 - DNA, 15 bp, Homo sapiens
gaaattaacatactt

SEQ ID NO: 8018 - DNA, 15 bp, Homo sapiens
tgaaattaacatact

SEQ ID NO: 8019 - DNA, 15 bp, Homo sapiens
atgaaattaacatac

SEQ ID NO: 8020 - DNA, 15 bp, Homo sapiens
catgaaattaacata

SEQ ID NO: 8021 - DNA, 15 bp, Homo sapiens
ccatgaaattaacat

SEQ ID NO: 8022 - DNA, 15 bp, Homo sapiens
accatgaaattaaca

SEQ ID NO: 8023 - DNA, 15 bp, Homo sapiens
taccatgaaattaac

SEQ ID NO: 8024 - DNA, 15 bp, Homo sapiens
gtaccatgaaattaa

SEQ ID NO: 8025 - DNA, 15 bp, Homo sapiens
tgtaccatgaaatta

SEQ ID NO: 8026 - DNA, 15 bp, Homo sapiens
atgtaccatgaaatt

SEQ ID NO: 8027 - DNA, 15 bp, Homo sapiens
catgtaccatgaaat

SEQ ID NO: 8028 - DNA, 15 bp, Homo sapiens
tcatgtaccatgaaa

SEQ ID NO: 8029 - DNA, 15 bp, Homo sapiens
ctcatgtaccatgaa

SEQ ID NO: 8030 - DNA, 15 bp, Homo sapiens
actcatgtaccatga

SEQ ID NO: 8031 - DNA, 15 bp, Homo sapiens
cactcatgtaccatg

SEQ ID NO: 8032 - DNA, 15 bp, Homo sapiens
ccactcatgtaccat

SEQ ID NO: 8033 - DNA, 15 bp, Homo sapiens
gccactcatgtacca

SEQ ID NO: 8034 - DNA, 15 bp, Homo sapiens
agccactcatgtacc

SEQ ID NO: 8035 - DNA, 15 bp, Homo sapiens
tagccactcatgtac

SEQ ID NO: 8036 - DNA, 15 bp, Homo sapiens
atagccactcatgta

SEQ ID NO: 8037 - DNA, 15 bp, Homo sapiens
gatagccactcatgt

SEQ ID NO: 8038 - DNA, 15 bp, Homo sapiens
tgatagccactcatg

SEQ ID NO: 8039 - DNA, 15 bp, Homo sapiens
atgatagccactcat

SEQ ID NO: 8040 - DNA, 15 bp, Homo sapiens
tatgatagccactca

SEQ ID NO: 8041 - DNA, 15 bp, Homo sapiens
gtatgatagccactc

SEQ ID NO: 8042 - DNA, 15 bp, Homo sapiens
agtatgatagccact

SEQ ID NO: 8043 - DNA, 15 bp, Homo sapiens
cagtatgatagccac

SEQ ID NO: 8044 - DNA, 15 bp, Homo sapiens
ccagtatgatagcca

SEQ ID NO: 8045 - DNA, 15 bp, Homo sapiens
gccagtatgatagcc

SEQ ID NO: 8046 - DNA, 15 bp, Homo sapiens
agccagtatgatagc

SEQ ID NO: 8047 - DNA, 15 bp, Homo sapiens
tagccagtatgatag

SEQ ID NO: 8048 - DNA, 15 bp, Homo sapiens
atagccagtatgata

SEQ ID NO: 8049 - DNA, 15 bp, Homo sapiens
aatagccagtatgat

SEQ ID NO: 8050 - DNA, 15 bp, Homo sapiens
taatagccagtatga

SEQ ID NO: 8051 - DNA, 15 bp, Homo sapiens
ataatagccagtatg

SEQ ID NO: 8052 - DNA, 15 bp, Homo sapiens
tataatagccagtat

SEQ ID NO: 8053 - DNA, 15 bp, Homo sapiens
atataatagccagta

SEQ ID NO: 8054 - DNA, 15 bp, Homo sapiens
catataatagccagt

SEQ ID NO: 8055 - DNA, 15 bp, Homo sapiens
ccatataatagccag

SEQ ID NO: 8056 - DNA, 15 bp, Homo sapiens
accatataatagcca

SEQ ID NO: 8057 - DNA, 15 bp, Homo sapiens
taccatataatagcc

SEQ ID NO: 8058 - DNA, 15 bp, Homo sapiens
ttaccatataatagc

SEQ ID NO: 8059 - DNA, 15 bp, Homo sapiens
cttaccatataatag

SEQ ID NO: 8060 - DNA, 15 bp, Homo sapiens
acttaccatataata

SEQ ID NO: 8061 - DNA, 15 bp, Homo sapiens
tacttaccatataat

SEQ ID NO: 8062 - DNA, 15 bp, Homo sapiens
ttacttaccatataa

SEQ ID NO: 8063 - DNA, 15 bp, Homo sapiens
attacttaccatata

SEQ ID NO: 8064 - DNA, 15 bp, Homo sapiens
gattacttaccatat

SEQ ID NO: 8065 - DNA, 15 bp, Homo sapiens
tgattacttaccata

SEQ ID NO: 8066 - DNA, 15 bp, Homo sapiens
gtgattacttaccat

SEQ ID NO: 8067 - DNA, 15 bp, Homo sapiens
agtgattacttacca

SEQ ID NO: 8068 - DNA, 15 bp, Homo sapiens
gagtgattacttacc

SEQ ID NO: 8069 - DNA, 15 bp, Homo sapiens
tgagtgattacttac

SEQ ID NO: 8070 - DNA, 15 bp, Homo sapiens
ctgagtgattactta

SEQ ID NO: 8071 - DNA, 15 bp, Homo sapiens
gctgagtgattactt

SEQ ID NO: 8072 - DNA, 15 bp, Homo sapiens
tgctgagtgattact

SEQ ID NO: 8073 - DNA, 15 bp, Homo sapiens
atgctgagtgattac

SEQ ID NO: 8074 - DNA, 15 bp, Homo sapiens
gatgctgagtgatta

SEQ ID NO: 8075 - DNA, 15 bp, Homo sapiens
agatgctgagtgatt

SEQ ID NO: 8076 - DNA, 15 bp, Homo sapiens
aagatgctgagtgat

SEQ ID NO: 8077 - DNA, 15 bp, Homo sapiens
aaagatgctgagtga

SEQ ID NO: 8078 - DNA, 15 bp, Homo sapiens
aaaagatgctgagtg

SEQ ID NO: 8079 - DNA, 15 bp, Homo sapiens
gaaaagatgctgagt

SEQ ID NO: 8080 - DNA, 15 bp, Homo sapiens
ggaaaagatgctgag

SEQ ID NO: 8081 - DNA, 15 bp, Homo sapiens
aggaaaagatgctga

SEQ ID NO: 8082 - DNA, 15 bp, Homo sapiens
caggaaaagatgctg

SEQ ID NO: 8083 - DNA, 15 bp, Homo sapiens
tcaggaaaagatgct

SEQ ID NO: 8084 - DNA, 15 bp, Homo sapiens
gtcaggaaaagatgc

SEQ ID NO: 8085 - DNA, 15 bp, Homo sapiens
tgtcaggaaaagatg

SEQ ID NO: 8086 - DNA, 15 bp, Homo sapiens
ttgtcaggaaaagat

SEQ ID NO: 8087 - DNA, 15 bp, Homo sapiens
attgtcaggaaaaga

SEQ ID NO: 8088 - DNA, 15 bp, Homo sapiens
aattgtcaggaaaag

SEQ ID NO: 8089 - DNA, 15 bp, Homo sapiens
aaattgtcaggaaaa

SEQ ID NO: 8090 - DNA, 15 bp, Homo sapiens
aaaattgtcaggaaa

SEQ ID NO: 8091 - DNA, 15 bp, Homo sapiens
aaaaattgtcaggaa

SEQ ID NO: 8092 - DNA, 15 bp, Homo sapiens
aaaaaattgtcagga

SEQ ID NO: 8093 - DNA, 15 bp, Homo sapiens
aaaaaaattgtcagg

SEQ ID NO: 8094 - DNA, 15 bp, Homo sapiens
caaaaaaattgtcag

SEQ ID NO: 8095 - DNA, 15 bp, Homo sapiens
acaaaaaaattgtca

SEQ ID NO: 8096 - DNA, 15 bp, Homo sapiens
tacaaaaaaattgtc

SEQ ID NO: 8097 - DNA, 15 bp, Homo sapiens
ctacaaaaaaattgt

SEQ ID NO: 8098 - DNA, 15 bp, Homo sapiens
actacaaaaaaattg

SEQ ID NO: 8099 - DNA, 15 bp, Homo sapiens
aactacaaaaaaatt

SEQ ID NO: 8100 - DNA, 15 bp, Homo sapiens
taactacaaaaaaat

SEQ ID NO: 8101 - DNA, 15 bp, Homo sapiens
ataactacaaaaaaa

SEQ ID NO: 8102 - DNA, 15 bp, Homo sapiens
cataactacaaaaaa

SEQ ID NO: 8103 - DNA, 15 bp, Homo sapiens
acataactacaaaaa

SEQ ID NO: 8104 - DNA, 15 bp, Homo sapiens
cacataactacaaaa

SEQ ID NO: 8105 - DNA, 15 bp, Homo sapiens
tcacataactacaaa

SEQ ID NO: 8106 - DNA, 15 bp, Homo sapiens
gtcacataactacaa

SEQ ID NO: 8107 - DNA, 15 bp, Homo sapiens
agtcacataactaca

SEQ ID NO: 8108 - DNA, 15 bp, Homo sapiens
aagtcacataactac

SEQ ID NO: 8109 - DNA, 15 bp, Homo sapiens
aaagtcacataacta

SEQ ID NO: 8110 - DNA, 15 bp, Homo sapiens
caaagtcacataact

SEQ ID NO: 8111 - DNA, 15 bp, Homo sapiens
acaaagtcacataac

SEQ ID NO: 8112 - DNA, 15 bp, Homo sapiens
aacaaagtcacataa

SEQ ID NO: 8113 - DNA, 15 bp, Homo sapiens
aaacaaagtcacata

SEQ ID NO: 8114 - DNA, 15 bp, Homo sapiens
aaaacaaagtcacat

SEQ ID NO: 8115 - DNA, 15 bp, Homo sapiens
caaaacaaagtcaca

SEQ ID NO: 8116 - DNA, 15 bp, Homo sapiens
acaaaacaaagtcac

SEQ ID NO: 8117 - DNA, 15 bp, Homo sapiens
tacaaaacaaagtca

SEQ ID NO: 8118 - DNA, 15 bp, Homo sapiens
ttacaaaacaaagtc

SEQ ID NO: 8119 - DNA, 15 bp, Homo sapiens
tttacaaaacaaagt

SEQ ID NO: 8120 - DNA, 15 bp, Homo sapiens
atttacaaaacaaag

SEQ ID NO: 8121 - DNA, 15 bp, Homo sapiens
aatttacaaaacaaa

SEQ ID NO: 8122 - DNA, 15 bp, Homo sapiens
aaatttacaaaacaa

SEQ ID NO: 8123 - DNA, 15 bp, Homo sapiens
taaatttacaaaaca

SEQ ID NO: 8124 - DNA, 15 bp, Homo sapiens
ataaatttacaaaac

SEQ ID NO: 8125 - DNA, 15 bp, Homo sapiens
tataaatttacaaaa

SEQ ID NO: 8126 - DNA, 15 bp, Homo sapiens
ttataaatttacaaa

SEQ ID NO: 8127 - DNA, 15 bp, Homo sapiens
tttataaatttacaa

SEQ ID NO: 8128 - DNA, 15 bp, Homo sapiens
ttttataaatttaca

SEQ ID NO: 8129 - DNA, 15 bp, Homo sapiens
attttataaatttac

SEQ ID NO: 8130 - DNA, 15 bp, Homo sapiens
tattttataaattta

SEQ ID NO: 8131 - DNA, 15 bp, Homo sapiens
gtattttataaattt

SEQ ID NO: 8132 - DNA, 15 bp, Homo sapiens
agtattttataaatt

SEQ ID NO: 8133 - DNA, 15 bp, Homo sapiens
tagtattttataaat

SEQ ID NO: 8134 - DNA, 15 bp, Homo sapiens
gtagtattttataaa

SEQ ID NO: 8135 - DNA, 15 bp, Homo sapiens
agtagtattttataa

SEQ ID NO: 8136 - DNA, 15 bp, Homo sapiens
aagtagtattttata

SEQ ID NO: 8137 - DNA, 15 bp, Homo sapiens
caagtagtattttat

SEQ ID NO: 8138 - DNA, 15 bp, Homo sapiens
gcaagtagtatttta

SEQ ID NO: 8139 - DNA, 15 bp, Homo sapiens
agcaagtagtatttt

SEQ ID NO: 8140 - DNA, 15 bp, Homo sapiens
aagcaagtagtattt

SEQ ID NO: 8141 - DNA, 15 bp, Homo sapiens
gaagcaagtagtatt

SEQ ID NO: 8142 - DNA, 15 bp, Homo sapiens
agaagcaagtagtat

SEQ ID NO: 8143 - DNA, 15 bp, Homo sapiens
gagaagcaagtagta

SEQ ID NO: 8144 - DNA, 15 bp, Homo sapiens
agagaagcaagtagt

SEQ ID NO: 8145 - DNA, 15 bp, Homo sapiens
gagagaagcaagtag

SEQ ID NO: 8146 - DNA, 15 bp, Homo sapiens
agagagaagcaagta

SEQ ID NO: 8147 - DNA, 15 bp, Homo sapiens
aagagagaagcaagt

SEQ ID NO: 8148 - DNA, 15 bp, Homo sapiens
aaagagagaagcaag

SEQ ID NO: 8149 - DNA, 15 bp, Homo sapiens
taaagagagaagcaa

SEQ ID NO: 8150 - DNA, 15 bp, Homo sapiens
ataaagagagaagca

SEQ ID NO: 8151 - DNA, 15 bp, Homo sapiens
tataaagagagaagc

SEQ ID NO: 8152 - DNA, 15 bp, Homo sapiens
atataaagagagaag

SEQ ID NO: 8153 - DNA, 15 bp, Homo sapiens
aatataaagagagaa

SEQ ID NO: 8154 - DNA, 15 bp, Homo sapiens
taatataaagagaga

SEQ ID NO: 8155 - DNA, 15 bp, Homo sapiens
gtaatataaagagag

SEQ ID NO: 8156 - DNA, 15 bp, Homo sapiens
agtaatataaagaga

SEQ ID NO: 8157 - DNA, 15 bp, Homo sapiens
tagtaatataaagag

SEQ ID NO: 8158 - DNA, 15 bp, Homo sapiens
ttagtaatataaaga

SEQ ID NO: 8159 - DNA, 15 bp, Homo sapiens
tttagtaatataaag

SEQ ID NO: 8160 - DNA, 15 bp, Homo sapiens
ttttagtaatataaa

SEQ ID NO: 8161 - DNA, 15 bp, Homo sapiens
tttttagtaatataa

SEQ ID NO: 8162 - DNA, 15 bp, Homo sapiens
ttttttagtaatata

SEQ ID NO: 8163 - DNA, 15 bp, Homo sapiens
attttttagtaatat

SEQ ID NO: 8164 - DNA, 15 bp, Homo sapiens
tattttttagtaata

SEQ ID NO: 8165 - DNA, 15 bp, Homo sapiens
ttattttttagtaat

SEQ ID NO: 8166 - DNA, 15 bp, Homo sapiens
tttattttttagtaa

SEQ ID NO: 8167 - DNA, 15 bp, Homo sapiens
ttttattttttagta

SEQ ID NO: 8168 - DNA, 15 bp, Homo sapiens
tttttattttttagt

SEQ ID NO: 8169 - DNA, 15 bp, Homo sapiens
atttttattttttag

SEQ ID NO: 8170 - DNA, 15 bp, Homo sapiens
tatttttatttttta

SEQ ID NO: 8171 - DNA, 15 bp, Homo sapiens
ttatttttatttttt

SEQ ID NO: 8172 - DNA, 15 bp, Homo sapiens
tttatttttattttt

SEQ ID NO: 8173 - DNA, 15 bp, Homo sapiens
ttttatttttatttt

SEQ ID NO: 8174 - DNA, 15 bp, Homo sapiens
tttttatttttattt

SEQ ID NO: 8175 - DNA, 15 bp, Homo sapiens
ttttttatttttatt

SEQ ID NO: 8176 - DNA, 15 bp, Homo sapiens
tttttttatttttat

SEQ ID NO: 8177 - DNA, 15 bp, Homo sapiens
atttttttattttta

SEQ ID NO: 8178 - DNA, 15 bp, Homo sapiens
tatttttttattttt

SEQ ID NO: 8179 - DNA, 15 bp, Homo sapiens
gtatttttttatttt

SEQ ID NO: 8180 - DNA, 15 bp, Homo sapiens
tgtatttttttattt

SEQ ID NO: 8181 - DNA, 15 bp, Homo sapiens
ttgtatttttttatt

SEQ ID NO: 8182 - DNA, 15 bp, Homo sapiens
gttgtatttttttat

SEQ ID NO: 8183 - DNA, 15 bp, Homo sapiens
agttgtattttttta

SEQ ID NO: 8184 - DNA, 15 bp, Homo sapiens
cagttgtattttttt

SEQ ID NO: 8185 - DNA, 15 bp, Homo sapiens
acagttgtatttttt

SEQ ID NO: 8186 - DNA, 15 bp, Homo sapiens
gacagttgtattttt

SEQ ID NO: 8187 - DNA, 15 bp, Homo sapiens
agacagttgtatttt

SEQ ID NO: 8188 - DNA, 15 bp, Homo sapiens
cagacagttgtattt

SEQ ID NO: 8189 - DNA, 15 bp, Homo sapiens
tcagacagttgtatt

SEQ ID NO: 8190 - DNA, 15 bp, Homo sapiens
ctcagacagttgtat

SEQ ID NO: 8191 - DNA, 15 bp, Homo sapiens
cctcagacagttgta

SEQ ID NO: 8192 - DNA, 15 bp, Homo sapiens
gcctcagacagttgt

SEQ ID NO: 8193 - DNA, 15 bp, Homo sapiens
taaaaatgttacggt

SEQ ID NO: 8194 - DNA, 15 bp, Homo sapiens
ataaaaatgttacgg

SEQ ID NO: 8195 - DNA, 15 bp, Homo sapiens
tataaaaatgttacg

SEQ ID NO: 8196 - DNA, 15 bp, Homo sapiens
atataaaaatgttac

SEQ ID NO: 8197 - DNA, 15 bp, Homo sapiens
tatataaaaatgtta

SEQ ID NO: 8198 - DNA, 15 bp, Homo sapiens
atatataaaaatgtt

SEQ ID NO: 8199 - DNA, 15 bp, Homo sapiens
gatatataaaaatgt

SEQ ID NO: 8200 - DNA, 15 bp, Homo sapiens
agatatataaaaatg

SEQ ID NO: 8201 - DNA, 15 bp, Homo sapiens
aagatatataaaaat

SEQ ID NO: 8202 - DNA, 15 bp, Homo sapiens
taagatatataaaaa

SEQ ID NO: 8203 - DNA, 15 bp, Homo sapiens
ataagatatataaaa

SEQ ID NO: 8204 - DNA, 15 bp, Homo sapiens
cataagatatataaa

SEQ ID NO: 8205 - DNA, 15 bp, Homo sapiens
tcataagatatataa

SEQ ID NO: 8206 - DNA, 15 bp, Homo sapiens
atcataagatatata

SEQ ID NO: 8207 - DNA, 15 bp, Homo sapiens
catcataagatatat

SEQ ID NO: 8208 - DNA, 15 bp, Homo sapiens
ggactggcttactga

SEQ ID NO: 8209 - DNA, 15 bp, Homo sapiens
gggactggcttactg

SEQ ID NO: 8210 - DNA, 15 bp, Homo sapiens
tgggactggcttact

SEQ ID NO: 8211 - DNA, 15 bp, Homo sapiens
atgggactggcttac

SEQ ID NO: 8212 - DNA, 15 bp, Homo sapiens
aatgggactggctta

SEQ ID NO: 8213 - DNA, 15 bp, Homo sapiens
gaatgggactggctt

SEQ ID NO: 8214 - DNA, 15 bp, Homo sapiens
ggaatgggactggct

SEQ ID NO: 8215 - DNA, 15 bp, Homo sapiens
gggaatgggactggc

SEQ ID NO: 8216 - DNA, 15 bp, Homo sapiens
ggggaatgggactgg

SEQ ID NO: 8217 - DNA, 15 bp, Homo sapiens
aggggaatgggactg

SEQ ID NO: 8218 - DNA, 15 bp, Homo sapiens
caggggaatgggact

SEQ ID NO: 8219 - DNA, 15 bp, Homo sapiens
tcaggggaatgggac

SEQ ID NO: 8220 - DNA, 15 bp, Homo sapiens
ttcaggggaatggga

SEQ ID NO: 8221 - DNA, 15 bp, Homo sapiens
gttcaggggaatggg

SEQ ID NO: 8222 - DNA, 15 bp, Homo sapiens
agttcaggggaatgg

SEQ ID NO: 8223 - DNA, 15 bp, Homo sapiens
tataccattattaac

SEQ ID NO: 8224 - DNA, 15 bp, Homo sapiens
gtataccattattaa

SEQ ID NO: 8225 - DNA, 15 bp, Homo sapiens
agtataccattatta

SEQ ID NO: 8226 - DNA, 15 bp, Homo sapiens
aagtataccattatt

SEQ ID NO: 8227 - DNA, 15 bp, Homo sapiens
gaagtataccattat

SEQ ID NO: 8228 - DNA, 15 bp, Homo sapiens
agaagtataccatta

SEQ ID NO: 8229 - DNA, 15 bp, Homo sapiens
gagaagtataccatt

SEQ ID NO: 8230 - DNA, 15 bp, Homo sapiens
agagaagtataccat

SEQ ID NO: 8231 - DNA, 15 bp, Homo sapiens
gagagaagtatacca

SEQ ID NO: 8232 - DNA, 15 bp, Homo sapiens
tgagagaagtatacc

SEQ ID NO: 8233 - DNA, 15 bp, Homo sapiens
ctgagagaagtatac

SEQ ID NO: 8234 - DNA, 15 bp, Homo sapiens
actgagagaagtata

SEQ ID NO: 8235 - DNA, 15 bp, Homo sapiens
cactgagagaagtat

SEQ ID NO: 8236 - DNA, 15 bp, Homo sapiens
gcactgagagaagta

SEQ ID NO: 8237 - DNA, 15 bp, Homo sapiens
agcactgagagaagt

SEQ ID NO: 8238 - DNA, 15 bp, Homo sapiens
ggcgccactgcactc

SEQ ID NO: 8239 - DNA, 15 bp, Homo sapiens
tggcgccactgcact

SEQ ID NO: 8240 - DNA, 15 bp, Homo sapiens
atggcgccactgcac

SEQ ID NO: 8241 - DNA, 15 bp, Homo sapiens
gatggcgccactgca

SEQ ID NO: 8242 - DNA, 15 bp, Homo sapiens
agatggcgccactgc

SEQ ID NO: 8243 - DNA, 15 bp, Homo sapiens
gagatggcgccactg

SEQ ID NO: 8244 - DNA, 15 bp, Homo sapiens
tgagatggcgccact

SEQ ID NO: 8245 - DNA, 15 bp, Homo sapiens
ctgagatggcgccac

SEQ ID NO: 8246 - DNA, 15 bp, Homo sapiens
gctgagatggcgcca

SEQ ID NO: 8247 - DNA, 15 bp, Homo sapiens
agctgagatggcgcc

SEQ ID NO: 8248 - DNA, 15 bp, Homo sapiens
gagctgagatggcgc

SEQ ID NO: 8249 - DNA, 15 bp, Homo sapiens
ggagctgagatggcg

SEQ ID NO: 8250 - DNA, 15 bp, Homo sapiens
caggcatgagccacc

SEQ ID NO: 8251 - DNA, 15 bp, Homo sapiens
acaggcatgagccac

SEQ ID NO: 8252 - DNA, 15 bp, Homo sapiens
tacaggcatgagcca

SEQ ID NO: 8253 - DNA, 15 bp, Homo sapiens
ttacaggcatgagcc

SEQ ID NO: 8254 - DNA, 15 bp, Homo sapiens
attacaggcatgagc

SEQ ID NO: 8255 - DNA, 15 bp, Homo sapiens
gattacaggcatgag

SEQ ID NO: 8256 - DNA, 15 bp, Homo sapiens
cggcaccatcttggg

SEQ ID NO: 8257 - DNA, 15 bp, Homo sapiens
gcggcaccatcttgg

SEQ ID NO: 8258 - DNA, 15 bp, Homo sapiens
agcggcaccatcttg

SEQ ID NO: 8259 - DNA, 15 bp, Homo sapiens
cagcggcaccatctt

SEQ ID NO: 8260 - DNA, 15 bp, Homo sapiens
gcagcggcaccatct

SEQ ID NO: 8261 - DNA, 15 bp, Homo sapiens
tgcagcggcaccatc

SEQ ID NO: 8262 - DNA, 15 bp, Homo sapiens
gtgcagcggcaccat

SEQ ID NO: 8263 - DNA, 15 bp, Homo sapiens
agtgcagcggcacca

SEQ ID NO: 8264 - DNA, 15 bp, Homo sapiens
gagtgcagcggcacc

SEQ ID NO: 8265 - DNA, 15 bp, Homo sapiens
ggagtgcagcggcac

SEQ ID NO: 8266 - DNA, 15 bp, Homo sapiens
tggagtgcagcggca

SEQ ID NO: 8267 - DNA, 15 bp, Homo sapiens
ctggagtgcagcggc

SEQ ID NO: 8268 - DNA, 15 bp, Homo sapiens
gctggagtgcagcgg

SEQ ID NO: 8269 - DNA, 15 bp, Homo sapiens
ggctggagtgcagcg

SEQ ID NO: 8270 - DNA, 15 bp, Homo sapiens
aggctggagtgcagc

SEQ ID NO: 8271 - DNA, 15 bp, Homo sapiens
cggtctgtgtgtatg

SEQ ID NO: 8272 - DNA, 15 bp, Homo sapiens
ccggtctgtgtgtat

SEQ ID NO: 8273 - DNA, 15 bp, Homo sapiens
cccggtctgtgtgta

SEQ ID NO: 8274 - DNA, 15 bp, Homo sapiens
gcccggtctgtgtgt

SEQ ID NO: 8275 - DNA, 15 bp, Homo sapiens
agcccggtctgtgtg

SEQ ID NO: 8276 - DNA, 15 bp, Homo sapiens
cagcccggtctgtgt

SEQ ID NO: 8277 - DNA, 15 bp, Homo sapiens
tcagcccggtctgtg

SEQ ID NO: 8278 - DNA, 15 bp, Homo sapiens
atcagcccggtctgt

SEQ ID NO: 8279 - DNA, 15 bp, Homo sapiens
gatcagcccggtctg

SEQ ID NO: 8280 - DNA, 15 bp, Homo sapiens
tgatcagcccggtct

SEQ ID NO: 8281 - DNA, 15 bp, Homo sapiens
atgatcagcccggtc

SEQ ID NO: 8282 - DNA, 15 bp, Homo sapiens
aatgatcagcccggt

SEQ ID NO: 8283 - DNA, 15 bp, Homo sapiens
caatgatcagcccgg

SEQ ID NO: 8284 - DNA, 15 bp, Homo sapiens
ccaatgatcagcccg

SEQ ID NO: 8285 - DNA, 15 bp, Homo sapiens
accaatgatcagccc

SEQ ID NO: 8286 - DNA, 15 bp, Homo sapiens
ggattacaggcatga

SEQ ID NO: 8287 - DNA, 15 bp, Homo sapiens
cttttttttttttga

SEQ ID NO: 8288 - DNA, 15 bp, Homo sapiens
tcttttttttttttg

SEQ ID NO: 8289 - DNA, 15 bp, Homo sapiens
tccttgaggccagaa

SEQ ID NO: 8290 - DNA, 15 bp, Homo sapiens
ttccttgaggccaga

SEQ ID NO: 8291 - DNA, 15 bp, Homo sapiens
attccttgaggccag

SEQ ID NO: 8292 - DNA, 15 bp, Homo sapiens
gattccttgaggcca

SEQ ID NO: 8293 - DNA, 15 bp, Homo sapiens
agattccttgaggcc

SEQ ID NO: 8294 - DNA, 15 bp, Homo sapiens
aagattccttgaggc

SEQ ID NO: 8295 - DNA, 15 bp, Homo sapiens
gaagattccttgagg

SEQ ID NO: 8296 - DNA, 15 bp, Homo sapiens
ggaagattccttgag

SEQ ID NO: 8297 - DNA, 15 bp, Homo sapiens
gggaagattccttga

SEQ ID NO: 8298 - DNA, 15 bp, Homo sapiens
tgggaagattccttg

SEQ ID NO: 8299 - DNA, 15 bp, Homo sapiens
gtgggaagattcctt

SEQ ID NO: 8300 - DNA, 15 bp, Homo sapiens
ggtgggaagattcct

SEQ ID NO: 8301 - DNA, 15 bp, Homo sapiens
aggtgggaagattcc

SEQ ID NO: 8302 - DNA, 15 bp, Homo sapiens
aaggtgggaagattc

SEQ ID NO: 8303 - DNA, 15 bp, Homo sapiens
caaggtgggaagatt

SEQ ID NO: 8304 - DNA, 15 bp, Homo sapiens
caaaaaaaaataaat

SEQ ID NO: 8305 - DNA, 15 bp, Homo sapiens
tcaaaaaaaaataaa

SEQ ID NO: 8306 - DNA, 15 bp, Homo sapiens
ctcaaaaaaaaataa

SEQ ID NO: 8307 - DNA, 15 bp, Homo sapiens
tctcaaaaaaaaata

SEQ ID NO: 8308 - DNA, 15 bp, Homo sapiens
gtctcaaaaaaaaat

SEQ ID NO: 8309 - DNA, 15 bp, Homo sapiens
ggcgtggtgactcat

SEQ ID NO: 8310 - DNA, 15 bp, Homo sapiens
ttgaggtcaggagtt

SEQ ID NO: 8311 - DNA, 15 bp, Homo sapiens
cttgaggtcaggagt

SEQ ID NO: 8312 - DNA, 15 bp, Homo sapiens
acttgaggtcaggag

SEQ ID NO: 8313 - DNA, 15 bp, Homo sapiens
tctaagagggtacat

SEQ ID NO: 8314 - DNA, 15 bp, Homo sapiens
ttctaagagggtaca

SEQ ID NO: 8315 - DNA, 15 bp, Homo sapiens
attctaagagggtac

SEQ ID NO: 8316 - DNA, 15 bp, Homo sapiens
tattctaagagggta

SEQ ID NO: 8317 - DNA, 15 bp, Homo sapiens
atattctaagagggt

SEQ ID NO: 8318 - DNA, 15 bp, Homo sapiens
tatattctaagaggg

SEQ ID NO: 8319 - DNA, 15 bp, Homo sapiens
atatattctaagagg

SEQ ID NO: 8320 - DNA, 15 bp, Homo sapiens
tatatattctaagag

SEQ ID NO: 8321 - DNA, 15 bp, Homo sapiens
gtatatattctaaga

SEQ ID NO: 8322 - DNA, 15 bp, Homo sapiens
tgtatatattctaag

SEQ ID NO: 8323 - DNA, 15 bp, Homo sapiens
atgtatatattctaa

SEQ ID NO: 8324 - DNA, 15 bp, Homo sapiens
gatgtatatattcta

SEQ ID NO: 8325 - DNA, 15 bp, Homo sapiens
tgatgtatatattct

SEQ ID NO: 8326 - DNA, 15 bp, Homo sapiens
atgatgtatatattc

SEQ ID NO: 8327 - DNA, 15 bp, Homo sapiens
catgatgtatatatt

SEQ ID NO: 8328 - DNA, 15 bp, Homo sapiens
agcctcagacagttg

SEQ ID NO: 8329 - DNA, 15 bp, Homo sapiens
aagcctcagacagtt

SEQ ID NO: 8330 - DNA, 15 bp, Homo sapiens
cttaatcacaccctt

SEQ ID NO: 8331 - DNA, 15 bp, Homo sapiens
ttaatcacaccctta

SEQ ID NO: 8332 - DNA, 15 bp, Homo sapiens
taatcacacccttat

SEQ ID NO: 8333 - DNA, 15 bp, Homo sapiens
aatcacacccttata

SEQ ID NO: 8334 - DNA, 15 bp, Homo sapiens
atcacacccttataa

SEQ ID NO: 8335 - DNA, 15 bp, Homo sapiens
tcacacccttataac

SEQ ID NO: 8336 - DNA, 15 bp, Homo sapiens
cacacccttataaca

SEQ ID NO: 8337 - DNA, 15 bp, Homo sapiens
acacccttataacaa

SEQ ID NO: 8338 - DNA, 15 bp, Homo sapiens
cacccttataacaaa

SEQ ID NO: 8339 - DNA, 15 bp, Homo sapiens
acccttataacaaaa

SEQ ID NO: 8340 - DNA, 15 bp, Homo sapiens
cccttataacaaaaa

SEQ ID NO: 8341 - DNA, 15 bp, Homo sapiens
ccttataacaaaaac

SEQ ID NO: 8342 - DNA, 15 bp, Homo sapiens
cttataacaaaaacc

SEQ ID NO: 8343 - DNA, 15 bp, Homo sapiens
ttataacaaaaacct

SEQ ID NO: 8344 - DNA, 15 bp, Homo sapiens
tataacaaaaacctg

SEQ ID NO: 8345 - DNA, 15 bp, Homo sapiens
ataacaaaaacctgc

SEQ ID NO: 8346 - DNA, 15 bp, Homo sapiens
taacaaaaacctgca

SEQ ID NO: 8347 - DNA, 15 bp, Homo sapiens
aacaaaaacctgcat

SEQ ID NO: 8348 - DNA, 15 bp, Homo sapiens
acaaaaacctgcata

SEQ ID NO: 8349 - DNA, 15 bp, Homo sapiens
caaaaacctgcatat

SEQ ID NO: 8350 - DNA, 15 bp, Homo sapiens
aaaaacctgcatatt

SEQ ID NO: 8351 - DNA, 15 bp, Homo sapiens
aaaacctgcatattt

SEQ ID NO: 8352 - DNA, 15 bp, Homo sapiens
aaacctgcatatttt

SEQ ID NO: 8353 - DNA, 15 bp, Homo sapiens
aacctgcatattttt

SEQ ID NO: 8354 - DNA, 15 bp, Homo sapiens
acctgcatatttttt

SEQ ID NO: 8355 - DNA, 15 bp, Homo sapiens
cctgcatattttttc

SEQ ID NO: 8356 - DNA, 15 bp, Homo sapiens
ctgcatattttttct

SEQ ID NO: 8357 - DNA, 15 bp, Homo sapiens
tgcatattttttctt

SEQ ID NO: 8358 - DNA, 15 bp, Homo sapiens
gcatattttttcttt

SEQ ID NO: 8359 - DNA, 15 bp, Homo sapiens
catattttttctttt

SEQ ID NO: 8360 - DNA, 15 bp, Homo sapiens
atattttttcttttt

SEQ ID NO: 8361 - DNA, 15 bp, Homo sapiens
tattttttcttttta

SEQ ID NO: 8362 - DNA, 15 bp, Homo sapiens
attttttctttttaa

SEQ ID NO: 8363 - DNA, 15 bp, Homo sapiens
ttttttctttttaaa

SEQ ID NO: 8364 - DNA, 15 bp, Homo sapiens
tttttctttttaaag

SEQ ID NO: 8365 - DNA, 15 bp, Homo sapiens
ttttctttttaaaga

SEQ ID NO: 8366 - DNA, 15 bp, Homo sapiens
tttctttttaaagaa

SEQ ID NO: 8367 - DNA, 15 bp, Homo sapiens
ttctttttaaagaat

SEQ ID NO: 8368 - DNA, 15 bp, Homo sapiens
tctttttaaagaatg

SEQ ID NO: 8369 - DNA, 15 bp, Homo sapiens
ctttttaaagaatga

SEQ ID NO: 8370 - DNA, 15 bp, Homo sapiens
tttttaaagaatgaa

SEQ ID NO: 8371 - DNA, 15 bp, Homo sapiens
ttttaaagaatgaaa

SEQ ID NO: 8372 - DNA, 15 bp, Homo sapiens
tttaaagaatgaaaa

SEQ ID NO: 8373 - DNA, 15 bp, Homo sapiens
ttaaagaatgaaaat

SEQ ID NO: 8374 - DNA, 15 bp, Homo sapiens
taaagaatgaaaatg

SEQ ID NO: 8375 - DNA, 15 bp, Homo sapiens
aaagaatgaaaatga

SEQ ID NO: 8376 - DNA, 15 bp, Homo sapiens
aagaatgaaaatgaa

SEQ ID NO: 8377 - DNA, 15 bp, Homo sapiens
agaatgaaaatgaaa

SEQ ID NO: 8378 - DNA, 15 bp, Homo sapiens
gaatgaaaatgaaag

SEQ ID NO: 8379 - DNA, 15 bp, Homo sapiens
aatgaaaatgaaagc

SEQ ID NO: 8380 - DNA, 15 bp, Homo sapiens
atgaaaatgaaagcc

SEQ ID NO: 8381 - DNA, 15 bp, Homo sapiens
tgaaaatgaaagcca

SEQ ID NO: 8382 - DNA, 15 bp, Homo sapiens
gaaaatgaaagccaa

SEQ ID NO: 8383 - DNA, 15 bp, Homo sapiens
aaaatgaaagccaag

SEQ ID NO: 8384 - DNA, 15 bp, Homo sapiens
aaatgaaagccaagt

SEQ ID NO: 8385 - DNA, 15 bp, Homo sapiens
aatgaaagccaagtt

SEQ ID NO: 8386 - DNA, 15 bp, Homo sapiens
atgaaagccaagttt

SEQ ID NO: 8387 - DNA, 15 bp, Homo sapiens
tgaaagccaagtttc

SEQ ID NO: 8388 - DNA, 15 bp, Homo sapiens
gaaagccaagtttca

SEQ ID NO: 8389 - DNA, 15 bp, Homo sapiens
aaagccaagtttcaa

SEQ ID NO: 8390 - DNA, 15 bp, Homo sapiens
aagccaagtttcaac

SEQ ID NO: 8391 - DNA, 15 bp, Homo sapiens
agccaagtttcaaca

SEQ ID NO: 8392 - DNA, 15 bp, Homo sapiens
gccaagtttcaacag

SEQ ID NO: 8393 - DNA, 15 bp, Homo sapiens
ccaagtttcaacaga

SEQ ID NO: 8394 - DNA, 15 bp, Homo sapiens
caagtttcaacagat

SEQ ID NO: 8395 - DNA, 15 bp, Homo sapiens
aagtttcaacagatg

SEQ ID NO: 8396 - DNA, 15 bp, Homo sapiens
agtttcaacagatga

SEQ ID NO: 8397 - DNA, 15 bp, Homo sapiens
gtttcaacagatgaa

SEQ ID NO: 8398 - DNA, 15 bp, Homo sapiens
tttcaacagatgaaa

SEQ ID NO: 8399 - DNA, 15 bp, Homo sapiens
ttcaacagatgaaag

SEQ ID NO: 8400 - DNA, 15 bp, Homo sapiens
tcaacagatgaaagt

SEQ ID NO: 8401 - DNA, 15 bp, Homo sapiens
caacagatgaaagtg

SEQ ID NO: 8402 - DNA, 15 bp, Homo sapiens
aacagatgaaagtga

SEQ ID NO: 8403 - DNA, 15 bp, Homo sapiens
acagatgaaagtgag

SEQ ID NO: 8404 - DNA, 15 bp, Homo sapiens
cagatgaaagtgaga

SEQ ID NO: 8405 - DNA, 15 bp, Homo sapiens
agatgaaagtgagaa

SEQ ID NO: 8406 - DNA, 15 bp, Homo sapiens
gatgaaagtgagaac

SEQ ID NO: 8407 - DNA, 15 bp, Homo sapiens
atgaaagtgagaact

SEQ ID NO: 8408 - DNA, 15 bp, Homo sapiens
tgaaagtgagaactc

SEQ ID NO: 8409 - DNA, 15 bp, Homo sapiens
gaaagtgagaactcc

SEQ ID NO: 8410 - DNA, 15 bp, Homo sapiens
aaagtgagaactcca

SEQ ID NO: 8411 - DNA, 15 bp, Homo sapiens
aagtgagaactccag

SEQ ID NO: 8412 - DNA, 15 bp, Homo sapiens
agtgagaactccagg

SEQ ID NO: 8413 - DNA, 15 bp, Homo sapiens
gtgagaactccaggt

SEQ ID NO: 8414 - DNA, 15 bp, Homo sapiens
tgagaactccaggtc

SEQ ID NO: 8415 - DNA, 15 bp, Homo sapiens
gagaactccaggtct

SEQ ID NO: 8416 - DNA, 15 bp, Homo sapiens
agaactccaggtctc

SEQ ID NO: 8417 - DNA, 15 bp, Homo sapiens
gaactccaggtctcc

SEQ ID NO: 8418 - DNA, 15 bp, Homo sapiens
aactccaggtctcct

SEQ ID NO: 8419 - DNA, 15 bp, Homo sapiens
actccaggtctcctg

SEQ ID NO: 8420 - DNA, 15 bp, Homo sapiens
ctccaggtctcctgg

SEQ ID NO: 8421 - DNA, 15 bp, Homo sapiens
tccaggtctcctgga

SEQ ID NO: 8422 - DNA, 15 bp, Homo sapiens
ccaggtctcctggaa

SEQ ID NO: 8423 - DNA, 15 bp, Homo sapiens
caggtctcctggaaa

SEQ ID NO: 8424 - DNA, 15 bp, Homo sapiens
aggtctcctggaaat

SEQ ID NO: 8425 - DNA, 15 bp, Homo sapiens
ggtctcctggaaata

SEQ ID NO: 8426 - DNA, 15 bp, Homo sapiens
gtctcctggaaataa

SEQ ID NO: 8427 - DNA, 15 bp, Homo sapiens
tctcctggaaataaa

SEQ ID NO: 8428 - DNA, 15 bp, Homo sapiens
ctcctggaaataaat

SEQ ID NO: 8429 - DNA, 15 bp, Homo sapiens
tcctggaaataaatc

SEQ ID NO: 8430 - DNA, 15 bp, Homo sapiens
cctggaaataaatca

SEQ ID NO: 8431 - DNA, 15 bp, Homo sapiens
ctggaaataaatcag

SEQ ID NO: 8432 - DNA, 15 bp, Homo sapiens
tggaaataaatcaga

SEQ ID NO: 8433 - DNA, 15 bp, Homo sapiens
ggaaataaatcagat

SEQ ID NO: 8434 - DNA, 15 bp, Homo sapiens
gaaataaatcagata

SEQ ID NO: 8435 - DNA, 15 bp, Homo sapiens
aaataaatcagataa

SEQ ID NO: 8436 - DNA, 15 bp, Homo sapiens
aataaatcagataac

SEQ ID NO: 8437 - DNA, 15 bp, Homo sapiens
ataaatcagataaca

SEQ ID NO: 8438 - DNA, 15 bp, Homo sapiens
taaatcagataacat

SEQ ID NO: 8439 - DNA, 15 bp, Homo sapiens
aaatcagataacatc

SEQ ID NO: 8440 - DNA, 15 bp, Homo sapiens
aatcagataacatca

SEQ ID NO: 8441 - DNA, 15 bp, Homo sapiens
atcagataacatcaa

SEQ ID NO: 8442 - DNA, 15 bp, Homo sapiens
tcagataacatcaag

SEQ ID NO: 8443 - DNA, 15 bp, Homo sapiens
cagataacatcaagc

SEQ ID NO: 8444 - DNA, 15 bp, Homo sapiens
agataacatcaagcc

SEQ ID NO: 8445 - DNA, 15 bp, Homo sapiens
gataacatcaagccc

SEQ ID NO: 8446 - DNA, 15 bp, Homo sapiens
ataacatcaagccca

SEQ ID NO: 8447 - DNA, 15 bp, Homo sapiens
taacatcaagcccaa

SEQ ID NO: 8448 - DNA, 15 bp, Homo sapiens
aacatcaagcccaaa

SEQ ID NO: 8449 - DNA, 15 bp, Homo sapiens
acatcaagcccaaat

SEQ ID NO: 8450 - DNA, 15 bp, Homo sapiens
catcaagcccaaatc

SEQ ID NO: 8451 - DNA, 15 bp, Homo sapiens
atcaagcccaaatct

SEQ ID NO: 8452 - DNA, 15 bp, Homo sapiens
tcaagcccaaatctg

SEQ ID NO: 8453 - DNA, 15 bp, Homo sapiens
caagcccaaatctgc

SEQ ID NO: 8454 - DNA, 15 bp, Homo sapiens
aagcccaaatctgct

SEQ ID NO: 8455 - DNA, 15 bp, Homo sapiens
agcccaaatctgctc

SEQ ID NO: 8456 - DNA, 15 bp, Homo sapiens
gcccaaatctgctcc

SEQ ID NO: 8457 - DNA, 15 bp, Homo sapiens
cccaaatctgctcca

SEQ ID NO: 8458 - DNA, 15 bp, Homo sapiens
ccaaatctgctccat

SEQ ID NO: 8459 - DNA, 15 bp, Homo sapiens
caaatctgctccatg

SEQ ID NO: 8460 - DNA, 15 bp, Homo sapiens
aaatctgctccatgg

SEQ ID NO: 8461 - DNA, 15 bp, Homo sapiens
aatctgctccatgga

SEQ ID NO: 8462 - DNA, 15 bp, Homo sapiens
atctgctccatggaa

SEQ ID NO: 8463 - DNA, 15 bp, Homo sapiens
tctgctccatggaac

SEQ ID NO: 8464 - DNA, 15 bp, Homo sapiens
ctgctccatggaact

SEQ ID NO: 8465 - DNA, 15 bp, Homo sapiens
tgctccatggaactc

SEQ ID NO: 8466 - DNA, 15 bp, Homo sapiens
gctccatggaactct

SEQ ID NO: 8467 - DNA, 15 bp, Homo sapiens
ctccatggaactctt

SEQ ID NO: 8468 - DNA, 15 bp, Homo sapiens
tccatggaactcttt

SEQ ID NO: 8469 - DNA, 15 bp, Homo sapiens
ccatggaactctttt

SEQ ID NO: 8470 - DNA, 15 bp, Homo sapiens
catggaactcttttc

SEQ ID NO: 8471 - DNA, 15 bp, Homo sapiens
atggaactcttttct

SEQ ID NO: 8472 - DNA, 15 bp, Homo sapiens
tggaactcttttctc

SEQ ID NO: 8473 - DNA, 15 bp, Homo sapiens
ggaactcttttctcc

SEQ ID NO: 8474 - DNA, 15 bp, Homo sapiens
gaactcttttctccc

SEQ ID NO: 8475 - DNA, 15 bp, Homo sapiens
aactcttttctccct

SEQ ID NO: 8476 - DNA, 15 bp, Homo sapiens
actcttttctccctc

SEQ ID NO: 8477 - DNA, 15 bp, Homo sapiens
ctcttttctccctcc

SEQ ID NO: 8478 - DNA, 15 bp, Homo sapiens
tcttttctccctcca

SEQ ID NO: 8479 - DNA, 15 bp, Homo sapiens
cttttctccctccac

SEQ ID NO: 8480 - DNA, 15 bp, Homo sapiens
ttttctccctccacc

SEQ ID NO: 8481 - DNA, 15 bp, Homo sapiens
tttctccctccacca

SEQ ID NO: 8482 - DNA, 15 bp, Homo sapiens
ttctccctccaccac

SEQ ID NO: 8483 - DNA, 15 bp, Homo sapiens
tctccctccaccacc

SEQ ID NO: 8484 - DNA, 15 bp, Homo sapiens
ctccctccaccaccc

SEQ ID NO: 8485 - DNA, 15 bp, Homo sapiens
tccctccaccacccc

SEQ ID NO: 8486 - DNA, 15 bp, Homo sapiens
ccctccaccaccccc

SEQ ID NO: 8487 - DNA, 15 bp, Homo sapiens
cctccaccacccccc

SEQ ID NO: 8488 - DNA, 15 bp, Homo sapiens
ctccaccacccccca

SEQ ID NO: 8489 - DNA, 15 bp, Homo sapiens
tccaccaccccccat

SEQ ID NO: 8490 - DNA, 15 bp, Homo sapiens
ccaccaccccccatg

SEQ ID NO: 8491 - DNA, 15 bp, Homo sapiens
caccaccccccatgc

SEQ ID NO: 8492 - DNA, 15 bp, Homo sapiens
accaccccccatgcc

SEQ ID NO: 8493 - DNA, 15 bp, Homo sapiens
ccaccccccatgcca

SEQ ID NO: 8494 - DNA, 15 bp, Homo sapiens
caccccccatgccag

SEQ ID NO: 8495 - DNA, 15 bp, Homo sapiens
accccccatgccagg

SEQ ID NO: 8496 - DNA, 15 bp, Homo sapiens
ccccccatgccaggg

SEQ ID NO: 8497 - DNA, 15 bp, Homo sapiens
cccccatgccagggc

SEQ ID NO: 8498 - DNA, 15 bp, Homo sapiens
ccccatgccagggcc

SEQ ID NO: 8499 - DNA, 15 bp, Homo sapiens
cccatgccagggcca

SEQ ID NO: 8500 - DNA, 15 bp, Homo sapiens
ccatgccagggccaa

SEQ ID NO: 8501 - DNA, 15 bp, Homo sapiens
catgccagggccaag

SEQ ID NO: 8502 - DNA, 15 bp, Homo sapiens
atgccagggccaaga

SEQ ID NO: 8503 - DNA, 15 bp, Homo sapiens
tgccagggccaagac

SEQ ID NO: 8504 - DNA, 15 bp, Homo sapiens
gccagggccaagact

SEQ ID NO: 8505 - DNA, 15 bp, Homo sapiens
ccagggccaagactg

SEQ ID NO: 8506 - DNA, 15 bp, Homo sapiens
cagggccaagactgg

SEQ ID NO: 8507 - DNA, 15 bp, Homo sapiens
agggccaagactggg

SEQ ID NO: 8508 - DNA, 15 bp, Homo sapiens
gggccaagactggga

SEQ ID NO: 8509 - DNA, 15 bp, Homo sapiens
ggccaagactgggac

SEQ ID NO: 8510 - DNA, 15 bp, Homo sapiens
gccaagactgggacc

SEQ ID NO: 8511 - DNA, 15 bp, Homo sapiens
ccaagactgggacca

SEQ ID NO: 8512 - DNA, 15 bp, Homo sapiens
caagactgggaccag

SEQ ID NO: 8513 - DNA, 15 bp, Homo sapiens
aagactgggaccagg

SEQ ID NO: 8514 - DNA, 15 bp, Homo sapiens
agactgggaccagga

SEQ ID NO: 8515 - DNA, 15 bp, Homo sapiens
gactgggaccaggaa

SEQ ID NO: 8516 - DNA, 15 bp, Homo sapiens
actgggaccaggaaa

SEQ ID NO: 8517 - DNA, 15 bp, Homo sapiens
ctgggaccaggaaag

SEQ ID NO: 8518 - DNA, 15 bp, Homo sapiens
tgggaccaggaaagg

SEQ ID NO: 8519 - DNA, 15 bp, Homo sapiens
gggaccaggaaaggt

SEQ ID NO: 8520 - DNA, 15 bp, Homo sapiens
ggaccaggaaaggta

SEQ ID NO: 8521 - DNA, 15 bp, Homo sapiens
gaccaggaaaggtaa

SEQ ID NO: 8522 - DNA, 15 bp, Homo sapiens
accaggaaaggtaaa

SEQ ID NO: 8523 - DNA, 15 bp, Homo sapiens
ccaggaaaggtaaac

SEQ ID NO: 8524 - DNA, 15 bp, Homo sapiens
caggaaaggtaaacc

SEQ ID NO: 8525 - DNA, 15 bp, Homo sapiens
aggaaaggtaaacct

SEQ ID NO: 8526 - DNA, 15 bp, Homo sapiens
ggaaaggtaaacctt

SEQ ID NO: 8527 - DNA, 15 bp, Homo sapiens
gaaaggtaaaccttc

SEQ ID NO: 8528 - DNA, 15 bp, Homo sapiens
aaaggtaaaccttct

SEQ ID NO: 8529 - DNA, 15 bp, Homo sapiens
aaggtaaaccttcta

SEQ ID NO: 8530 - DNA, 15 bp, Homo sapiens
aggtaaaccttctat

SEQ ID NO: 8531 - DNA, 15 bp, Homo sapiens
ggtaaaccttctatg

SEQ ID NO: 8532 - DNA, 15 bp, Homo sapiens
gtaaaccttctatga

SEQ ID NO: 8533 - DNA, 15 bp, Homo sapiens
taaaccttctatgaa

SEQ ID NO: 8534 - DNA, 15 bp, Homo sapiens
aaaccttctatgaaa

SEQ ID NO: 8535 - DNA, 15 bp, Homo sapiens
aaccttctatgaaag

SEQ ID NO: 8536 - DNA, 15 bp, Homo sapiens
accttctatgaaagt

SEQ ID NO: 8537 - DNA, 15 bp, Homo sapiens
ccttctatgaaagtt

SEQ ID NO: 8538 - DNA, 15 bp, Homo sapiens
cttctatgaaagttt

SEQ ID NO: 8539 - DNA, 15 bp, Homo sapiens
ttctatgaaagtttt

SEQ ID NO: 8540 - DNA, 15 bp, Homo sapiens
tctatgaaagttttc

SEQ ID NO: 8541 - DNA, 15 bp, Homo sapiens
ctatgaaagttttcc

SEQ ID NO: 8542 - DNA, 15 bp, Homo sapiens
tatgaaagttttcca

SEQ ID NO: 8543 - DNA, 15 bp, Homo sapiens
atgaaagttttccag

SEQ ID NO: 8544 - DNA, 15 bp, Homo sapiens
tgaaagttttccaga

SEQ ID NO: 8545 - DNA, 15 bp, Homo sapiens
gaaagttttccagaa

SEQ ID NO: 8546 - DNA, 15 bp, Homo sapiens
aaagttttccagaaa

SEQ ID NO: 8547 - DNA, 15 bp, Homo sapiens
aagttttccagaaaa

SEQ ID NO: 8548 - DNA, 15 bp, Homo sapiens
agttttccagaaaat

SEQ ID NO: 8549 - DNA, 15 bp, Homo sapiens
gttttccagaaaata

SEQ ID NO: 8550 - DNA, 15 bp, Homo sapiens
ttttccagaaaatag

SEQ ID NO: 8551 - DNA, 15 bp, Homo sapiens
tttccagaaaatagt

SEQ ID NO: 8552 - DNA, 15 bp, Homo sapiens
ttccagaaaatagtt

SEQ ID NO: 8553 - DNA, 15 bp, Homo sapiens
tccagaaaatagtta

SEQ ID NO: 8554 - DNA, 15 bp, Homo sapiens
ccagaaaatagttaa

SEQ ID NO: 8555 - DNA, 15 bp, Homo sapiens
cagaaaatagttaat

SEQ ID NO: 8556 - DNA, 15 bp, Homo sapiens
agaaaatagttaatg

SEQ ID NO: 8557 - DNA, 15 bp, Homo sapiens
gaaaatagttaatgt

SEQ ID NO: 8558 - DNA, 15 bp, Homo sapiens
aaaatagttaatgtc

SEQ ID NO: 8559 - DNA, 15 bp, Homo sapiens
aaatagttaatgtcg

SEQ ID NO: 8560 - DNA, 15 bp, Homo sapiens
aatagttaatgtcgg

SEQ ID NO: 8561 - DNA, 15 bp, Homo sapiens
atagttaatgtcggg

SEQ ID NO: 8562 - DNA, 15 bp, Homo sapiens
tagttaatgtcggga

SEQ ID NO: 8563 - DNA, 15 bp, Homo sapiens
agttaatgtcgggac

SEQ ID NO: 8564 - DNA, 15 bp, Homo sapiens
gttaatgtcgggaca

SEQ ID NO: 8565 - DNA, 15 bp, Homo sapiens
ttaatgtcgggacat

SEQ ID NO: 8566 - DNA, 15 bp, Homo sapiens
taatgtcgggacatt

SEQ ID NO: 8567 - DNA, 15 bp, Homo sapiens
aatgtcgggacattt

SEQ ID NO: 8568 - DNA, 15 bp, Homo sapiens
atgtcgggacattta

SEQ ID NO: 8569 - DNA, 15 bp, Homo sapiens
tgtcgggacatttaa

SEQ ID NO: 8570 - DNA, 15 bp, Homo sapiens
gtcgggacatttaac

SEQ ID NO: 8571 - DNA, 15 bp, Homo sapiens
tcgggacatttaacc

SEQ ID NO: 8572 - DNA, 15 bp, Homo sapiens
cgggacatttaacct

SEQ ID NO: 8573 - DNA, 15 bp, Homo sapiens
gggacatttaacctc

SEQ ID NO: 8574 - DNA, 15 bp, Homo sapiens
ggacatttaacctct

SEQ ID NO: 8575 - DNA, 15 bp, Homo sapiens
gacatttaacctctc

SEQ ID NO: 8576 - DNA, 15 bp, Homo sapiens
acatttaacctctct

SEQ ID NO: 8577 - DNA, 15 bp, Homo sapiens
catttaacctctctg

SEQ ID NO: 8578 - DNA, 15 bp, Homo sapiens
atttaacctctctgt

SEQ ID NO: 8579 - DNA, 15 bp, Homo sapiens
tttaacctctctgtt

SEQ ID NO: 8580 - DNA, 15 bp, Homo sapiens
ttaacctctctgtta

SEQ ID NO: 8581 - DNA, 15 bp, Homo sapiens
taacctctctgttaa

SEQ ID NO: 8582 - DNA, 15 bp, Homo sapiens
aacctctctgttaac

SEQ ID NO: 8583 - DNA, 15 bp, Homo sapiens
acctctctgttaact

SEQ ID NO: 8584 - DNA, 15 bp, Homo sapiens
cctctctgttaacta

SEQ ID NO: 8585 - DNA, 15 bp, Homo sapiens
ctctctgttaactaa

SEQ ID NO: 8586 - DNA, 15 bp, Homo sapiens
tctctgttaactaat

SEQ ID NO: 8587 - DNA, 15 bp, Homo sapiens
ctctgttaactaatt

SEQ ID NO: 8588 - DNA, 15 bp, Homo sapiens
tctgttaactaattt

SEQ ID NO: 8589 - DNA, 15 bp, Homo sapiens
ctgttaactaatttg

SEQ ID NO: 8590 - DNA, 15 bp, Homo sapiens
tgttaactaatttgt

SEQ ID NO: 8591 - DNA, 15 bp, Homo sapiens
gttaactaatttgta

SEQ ID NO: 8592 - DNA, 15 bp, Homo sapiens
ttaactaatttgtag

SEQ ID NO: 8593 - DNA, 15 bp, Homo sapiens
taactaatttgtagc

SEQ ID NO: 8594 - DNA, 15 bp, Homo sapiens
aactaatttgtagct

SEQ ID NO: 8595 - DNA, 15 bp, Homo sapiens
actaatttgtagctc

SEQ ID NO: 8596 - DNA, 15 bp, Homo sapiens
ctaatttgtagctct

SEQ ID NO: 8597 - DNA, 15 bp, Homo sapiens
taatttgtagctctc

SEQ ID NO: 8598 - DNA, 15 bp, Homo sapiens
aatttgtagctctcc

SEQ ID NO: 8599 - DNA, 15 bp, Homo sapiens
atttgtagctctccc

SEQ ID NO: 8600 - DNA, 15 bp, Homo sapiens
tttgtagctctccca

SEQ ID NO: 8601 - DNA, 15 bp, Homo sapiens
ttgtagctctcccat

SEQ ID NO: 8602 - DNA, 15 bp, Homo sapiens
tgtagctctcccatg

SEQ ID NO: 8603 - DNA, 15 bp, Homo sapiens
gtagctctcccatga

SEQ ID NO: 8604 - DNA, 15 bp, Homo sapiens
tagctctcccatgaa

SEQ ID NO: 8605 - DNA, 15 bp, Homo sapiens
agctctcccatgaaa

SEQ ID NO: 8606 - DNA, 15 bp, Homo sapiens
gctctcccatgaaac

SEQ ID NO: 8607 - DNA, 15 bp, Homo sapiens
ctctcccatgaaact

SEQ ID NO: 8608 - DNA, 15 bp, Homo sapiens
tctcccatgaaactt

SEQ ID NO: 8609 - DNA, 15 bp, Homo sapiens
ctcccatgaaacttt

SEQ ID NO: 8610 - DNA, 15 bp, Homo sapiens
tcccatgaaactttt

SEQ ID NO: 8611 - DNA, 15 bp, Homo sapiens
cccatgaaacttttg

SEQ ID NO: 8612 - DNA, 15 bp, Homo sapiens
ccatgaaacttttgt

SEQ ID NO: 8613 - DNA, 15 bp, Homo sapiens
catgaaacttttgta

SEQ ID NO: 8614 - DNA, 15 bp, Homo sapiens
atgaaacttttgtag

SEQ ID NO: 8615 - DNA, 15 bp, Homo sapiens
tgaaacttttgtagc

SEQ ID NO: 8616 - DNA, 15 bp, Homo sapiens
gaaacttttgtagct

SEQ ID NO: 8617 - DNA, 15 bp, Homo sapiens
aaacttttgtagctt

SEQ ID NO: 8618 - DNA, 15 bp, Homo sapiens
aacttttgtagctta

SEQ ID NO: 8619 - DNA, 15 bp, Homo sapiens
acttttgtagcttaa

SEQ ID NO: 8620 - DNA, 15 bp, Homo sapiens
cttttgtagcttaaa

SEQ ID NO: 8621 - DNA, 15 bp, Homo sapiens
ttttgtagcttaaat

SEQ ID NO: 8622 - DNA, 15 bp, Homo sapiens
tttgtagcttaaata

SEQ ID NO: 8623 - DNA, 15 bp, Homo sapiens
ttgtagcttaaatac

SEQ ID NO: 8624 - DNA, 15 bp, Homo sapiens
tgtagcttaaataca

SEQ ID NO: 8625 - DNA, 15 bp, Homo sapiens
gtagcttaaatacac

SEQ ID NO: 8626 - DNA, 15 bp, Homo sapiens
tagcttaaatacaca

SEQ ID NO: 8627 - DNA, 15 bp, Homo sapiens
agcttaaatacacaa

SEQ ID NO: 8628 - DNA, 15 bp, Homo sapiens
gcttaaatacacaag

SEQ ID NO: 8629 - DNA, 15 bp, Homo sapiens
cttaaatacacaaga

SEQ ID NO: 8630 - DNA, 15 bp, Homo sapiens
ttaaatacacaagaa

SEQ ID NO: 8631 - DNA, 15 bp, Homo sapiens
taaatacacaagaat

SEQ ID NO: 8632 - DNA, 15 bp, Homo sapiens
aaatacacaagaatt

SEQ ID NO: 8633 - DNA, 15 bp, Homo sapiens
aatacacaagaattt

SEQ ID NO: 8634 - DNA, 15 bp, Homo sapiens
atacacaagaatttt

SEQ ID NO: 8635 - DNA, 15 bp, Homo sapiens
tacacaagaattttt

SEQ ID NO: 8636 - DNA, 15 bp, Homo sapiens
acacaagaatttttt

SEQ ID NO: 8637 - DNA, 15 bp, Homo sapiens
cacaagaattttttg

SEQ ID NO: 8638 - DNA, 15 bp, Homo sapiens
acaagaattttttga

SEQ ID NO: 8639 - DNA, 15 bp, Homo sapiens
caagaattttttgaa

SEQ ID NO: 8640 - DNA, 15 bp, Homo sapiens
aagaattttttgaaa

SEQ ID NO: 8641 - DNA, 15 bp, Homo sapiens
agaattttttgaaaa

SEQ ID NO: 8642 - DNA, 15 bp, Homo sapiens
gaattttttgaaaag

SEQ ID NO: 8643 - DNA, 15 bp, Homo sapiens
aattttttgaaaagg

SEQ ID NO: 8644 - DNA, 15 bp, Homo sapiens
attttttgaaaagga

SEQ ID NO: 8645 - DNA, 15 bp, Homo sapiens
ttttttgaaaaggaa

SEQ ID NO: 8646 - DNA, 15 bp, Homo sapiens
tttttgaaaaggaaa

SEQ ID NO: 8647 - DNA, 15 bp, Homo sapiens
ttttgaaaaggaaat

SEQ ID NO: 8648 - DNA, 15 bp, Homo sapiens
tttgaaaaggaaata

SEQ ID NO: 8649 - DNA, 15 bp, Homo sapiens
ttgaaaaggaaataa

SEQ ID NO: 8650 - DNA, 15 bp, Homo sapiens
tgaaaaggaaataag

SEQ ID NO: 8651 - DNA, 15 bp, Homo sapiens
gaaaaggaaataaga

SEQ ID NO: 8652 - DNA, 15 bp, Homo sapiens
aaaaggaaataagat

SEQ ID NO: 8653 - DNA, 15 bp, Homo sapiens
aaaggaaataagata

SEQ ID NO: 8654 - DNA, 15 bp, Homo sapiens
aaggaaataagataa

SEQ ID NO: 8655 - DNA, 15 bp, Homo sapiens
aggaaataagataat

SEQ ID NO: 8656 - DNA, 15 bp, Homo sapiens
ggaaataagataatg

SEQ ID NO: 8657 - DNA, 15 bp, Homo sapiens
gaaataagataatga

SEQ ID NO: 8658 - DNA, 15 bp, Homo sapiens
aaataagataatgat

SEQ ID NO: 8659 - DNA, 15 bp, Homo sapiens
aataagataatgatg

SEQ ID NO: 8660 - DNA, 15 bp, Homo sapiens
ataagataatgatgc

SEQ ID NO: 8661 - DNA, 15 bp, Homo sapiens
taagataatgatgca

SEQ ID NO: 8662 - DNA, 15 bp, Homo sapiens
aagataatgatgcaa

SEQ ID NO: 8663 - DNA, 15 bp, Homo sapiens
agataatgatgcaaa

SEQ ID NO: 8664 - DNA, 15 bp, Homo sapiens
gataatgatgcaaaa

SEQ ID NO: 8665 - DNA, 15 bp, Homo sapiens
ataatgatgcaaaat

SEQ ID NO: 8666 - DNA, 15 bp, Homo sapiens
taatgatgcaaaata

SEQ ID NO: 8667 - DNA, 15 bp, Homo sapiens
aatgatgcaaaatag

SEQ ID NO: 8668 - DNA, 15 bp, Homo sapiens
atgatgcaaaatagt

SEQ ID NO: 8669 - DNA, 15 bp, Homo sapiens
tgatgcaaaatagtt

SEQ ID NO: 8670 - DNA, 15 bp, Homo sapiens
gatgcaaaatagtta

SEQ ID NO: 8671 - DNA, 15 bp, Homo sapiens
atgcaaaatagttaa

SEQ ID NO: 8672 - DNA, 15 bp, Homo sapiens
tgcaaaatagttaat

SEQ ID NO: 8673 - DNA, 15 bp, Homo sapiens
gcaaaatagttaatt

SEQ ID NO: 8674 - DNA, 15 bp, Homo sapiens
caaaatagttaattt

SEQ ID NO: 8675 - DNA, 15 bp, Homo sapiens
aaaatagttaatttt

SEQ ID NO: 8676 - DNA, 15 bp, Homo sapiens
aaatagttaattttt

SEQ ID NO: 8677 - DNA, 15 bp, Homo sapiens
aatagttaatttttt

SEQ ID NO: 8678 - DNA, 15 bp, Homo sapiens
atagttaatttttta

SEQ ID NO: 8679 - DNA, 15 bp, Homo sapiens
tagttaattttttaa

SEQ ID NO: 8680 - DNA, 15 bp, Homo sapiens
agttaattttttaaa

SEQ ID NO: 8681 - DNA, 15 bp, Homo sapiens
gttaattttttaaaa

SEQ ID NO: 8682 - DNA, 15 bp, Homo sapiens
ttaattttttaaaaa

SEQ ID NO: 8683 - DNA, 15 bp, Homo sapiens
taattttttaaaaaa

SEQ ID NO: 8684 - DNA, 15 bp, Homo sapiens
aattttttaaaaaaa

SEQ ID NO: 8685 - DNA, 15 bp, Homo sapiens
attttttaaaaaaat

SEQ ID NO: 8686 - DNA, 15 bp, Homo sapiens
ttttttaaaaaaatg

SEQ ID NO: 8687 - DNA, 15 bp, Homo sapiens
tttttaaaaaaatgt

SEQ ID NO: 8688 - DNA, 15 bp, Homo sapiens
ttttaaaaaaatgtt

SEQ ID NO: 8689 - DNA, 15 bp, Homo sapiens
tttaaaaaaatgtta

SEQ ID NO: 8690 - DNA, 15 bp, Homo sapiens
ttaaaaaaatgttag

SEQ ID NO: 8691 - DNA, 15 bp, Homo sapiens
taaaaaaatgttaga

SEQ ID NO: 8692 - DNA, 15 bp, Homo sapiens
aaaaaaatgttagac

SEQ ID NO: 8693 - DNA, 15 bp, Homo sapiens
aaaaaatgttagaca

SEQ ID NO: 8694 - DNA, 15 bp, Homo sapiens
aaaaatgttagacac

SEQ ID NO: 8695 - DNA, 15 bp, Homo sapiens
aaaatgttagacact

SEQ ID NO: 8696 - DNA, 15 bp, Homo sapiens
aaatgttagacactg

SEQ ID NO: 8697 - DNA, 15 bp, Homo sapiens
aatgttagacactgc

SEQ ID NO: 8698 - DNA, 15 bp, Homo sapiens
atgttagacactgca

SEQ ID NO: 8699 - DNA, 15 bp, Homo sapiens
tgttagacactgcag

SEQ ID NO: 8700 - DNA, 15 bp, Homo sapiens
gttagacactgcagt

SEQ ID NO: 8701 - DNA, 15 bp, Homo sapiens
ttagacactgcagtg

SEQ ID NO: 8702 - DNA, 15 bp, Homo sapiens
tagacactgcagtgg

SEQ ID NO: 8703 - DNA, 15 bp, Homo sapiens
agacactgcagtgga

SEQ ID NO: 8704 - DNA, 15 bp, Homo sapiens
gacactgcagtggat

SEQ ID NO: 8705 - DNA, 15 bp, Homo sapiens
acactgcagtggatg

SEQ ID NO: 8706 - DNA, 15 bp, Homo sapiens
cactgcagtggatgc

SEQ ID NO: 8707 - DNA, 15 bp, Homo sapiens
actgcagtggatgca

SEQ ID NO: 8708 - DNA, 15 bp, Homo sapiens
ctgcagtggatgcaa

SEQ ID NO: 8709 - DNA, 15 bp, Homo sapiens
tgcagtggatgcaac

SEQ ID NO: 8710 - DNA, 15 bp, Homo sapiens
gcagtggatgcaaca

SEQ ID NO: 8711 - DNA, 15 bp, Homo sapiens
cagtggatgcaacaa

SEQ ID NO: 8712 - DNA, 15 bp, Homo sapiens
agtggatgcaacaaa

SEQ ID NO: 8713 - DNA, 15 bp, Homo sapiens
gtggatgcaacaaaa

SEQ ID NO: 8714 - DNA, 15 bp, Homo sapiens
tggatgcaacaaaat

SEQ ID NO: 8715 - DNA, 15 bp, Homo sapiens
ggatgcaacaaaata

SEQ ID NO: 8716 - DNA, 15 bp, Homo sapiens
gatgcaacaaaatac

SEQ ID NO: 8717 - DNA, 15 bp, Homo sapiens
atgcaacaaaatact

SEQ ID NO: 8718 - DNA, 15 bp, Homo sapiens
tgcaacaaaatactt

SEQ ID NO: 8719 - DNA, 15 bp, Homo sapiens
gcaacaaaatacttt

SEQ ID NO: 8720 - DNA, 15 bp, Homo sapiens
caacaaaatacttta

SEQ ID NO: 8721 - DNA, 15 bp, Homo sapiens
aacaaaatactttat

SEQ ID NO: 8722 - DNA, 15 bp, Homo sapiens
acaaaatactttata

SEQ ID NO: 8723 - DNA, 15 bp, Homo sapiens
caaaatactttatat

SEQ ID NO: 8724 - DNA, 15 bp, Homo sapiens
aaaatactttatatg

SEQ ID NO: 8725 - DNA, 15 bp, Homo sapiens
aaatactttatatga

SEQ ID NO: 8726 - DNA, 15 bp, Homo sapiens
aatactttatatgaa

SEQ ID NO: 8727 - DNA, 15 bp, Homo sapiens
atactttatatgaaa

SEQ ID NO: 8728 - DNA, 15 bp, Homo sapiens
tactttatatgaaag

SEQ ID NO: 8729 - DNA, 15 bp, Homo sapiens
actttatatgaaaga

SEQ ID NO: 8730 - DNA, 15 bp, Homo sapiens
ctttatatgaaagat

SEQ ID NO: 8731 - DNA, 15 bp, Homo sapiens
tttatatgaaagatt

SEQ ID NO: 8732 - DNA, 15 bp, Homo sapiens
ttatatgaaagattt

SEQ ID NO: 8733 - DNA, 15 bp, Homo sapiens
tatatgaaagattta

SEQ ID NO: 8734 - DNA, 15 bp, Homo sapiens
atatgaaagatttat

SEQ ID NO: 8735 - DNA, 15 bp, Homo sapiens
tatgaaagatttatc

SEQ ID NO: 8736 - DNA, 15 bp, Homo sapiens
atgaaagatttatcc

SEQ ID NO: 8737 - DNA, 15 bp, Homo sapiens
tgaaagatttatcca

SEQ ID NO: 8738 - DNA, 15 bp, Homo sapiens
gaaagatttatccag

SEQ ID NO: 8739 - DNA, 15 bp, Homo sapiens
aaagatttatccagt

SEQ ID NO: 8740 - DNA, 15 bp, Homo sapiens
aagatttatccagtt

SEQ ID NO: 8741 - DNA, 15 bp, Homo sapiens
agatttatccagtta

SEQ ID NO: 8742 - DNA, 15 bp, Homo sapiens
gatttatccagttaa

SEQ ID NO: 8743 - DNA, 15 bp, Homo sapiens
atttatccagttaac

SEQ ID NO: 8744 - DNA, 15 bp, Homo sapiens
tttatccagttaact

SEQ ID NO: 8745 - DNA, 15 bp, Homo sapiens
ttatccagttaactt

SEQ ID NO: 8746 - DNA, 15 bp, Homo sapiens
tatccagttaacttt

SEQ ID NO: 8747 - DNA, 15 bp, Homo sapiens
atccagttaactttt

SEQ ID NO: 8748 - DNA, 15 bp, Homo sapiens
tccagttaacttttg

SEQ ID NO: 8749 - DNA, 15 bp, Homo sapiens
ccagttaacttttgt

SEQ ID NO: 8750 - DNA, 15 bp, Homo sapiens
cagttaacttttgtg

SEQ ID NO: 8751 - DNA, 15 bp, Homo sapiens
agttaacttttgtgg

SEQ ID NO: 8752 - DNA, 15 bp, Homo sapiens
gttaacttttgtgga

SEQ ID NO: 8753 - DNA, 15 bp, Homo sapiens
ttaacttttgtggag

SEQ ID NO: 8754 - DNA, 15 bp, Homo sapiens
taacttttgtggagt

SEQ ID NO: 8755 - DNA, 15 bp, Homo sapiens
aacttttgtggagta

SEQ ID NO: 8756 - DNA, 15 bp, Homo sapiens
acttttgtggagtat

SEQ ID NO: 8757 - DNA, 15 bp, Homo sapiens
cttttgtggagtatt

SEQ ID NO: 8758 - DNA, 15 bp, Homo sapiens
ttttgtggagtatta

SEQ ID NO: 8759 - DNA, 15 bp, Homo sapiens
tttgtggagtattag

SEQ ID NO: 8760 - DNA, 15 bp, Homo sapiens
ttgtggagtattagg

SEQ ID NO: 8761 - DNA, 15 bp, Homo sapiens
tgtggagtattaggt

SEQ ID NO: 8762 - DNA, 15 bp, Homo sapiens
gtggagtattaggta

SEQ ID NO: 8763 - DNA, 15 bp, Homo sapiens
tggagtattaggtat

SEQ ID NO: 8764 - DNA, 15 bp, Homo sapiens
ggagtattaggtatt

SEQ ID NO: 8765 - DNA, 15 bp, Homo sapiens
gagtattaggtatta

SEQ ID NO: 8766 - DNA, 15 bp, Homo sapiens
agtattaggtattag

SEQ ID NO: 8767 - DNA, 15 bp, Homo sapiens
gtattaggtattaga

SEQ ID NO: 8768 - DNA, 15 bp, Homo sapiens
tattaggtattagac

SEQ ID NO: 8769 - DNA, 15 bp, Homo sapiens
attaggtattagact

SEQ ID NO: 8770 - DNA, 15 bp, Homo sapiens
ttaggtattagacta

SEQ ID NO: 8771 - DNA, 15 bp, Homo sapiens
taggtattagactaa

SEQ ID NO: 8772 - DNA, 15 bp, Homo sapiens
aggtattagactaat

SEQ ID NO: 8773 - DNA, 15 bp, Homo sapiens
ggtattagactaata

SEQ ID NO: 8774 - DNA, 15 bp, Homo sapiens
gtattagactaataa

SEQ ID NO: 8775 - DNA, 15 bp, Homo sapiens
tattagactaataat

SEQ ID NO: 8776 - DNA, 15 bp, Homo sapiens
attagactaataatt

SEQ ID NO: 8777 - DNA, 15 bp, Homo sapiens
ttagactaataatta

SEQ ID NO: 8778 - DNA, 15 bp, Homo sapiens
tagactaataattag

SEQ ID NO: 8779 - DNA, 15 bp, Homo sapiens
agactaataattagc

SEQ ID NO: 8780 - DNA, 15 bp, Homo sapiens
gactaataattagca

SEQ ID NO: 8781 - DNA, 15 bp, Homo sapiens
actaataattagcac

SEQ ID NO: 8782 - DNA, 15 bp, Homo sapiens
ctaataattagcaca

SEQ ID NO: 8783 - DNA, 15 bp, Homo sapiens
taataattagcacac

SEQ ID NO: 8784 - DNA, 15 bp, Homo sapiens
aataattagcacact

SEQ ID NO: 8785 - DNA, 15 bp, Homo sapiens
ataattagcacactt

SEQ ID NO: 8786 - DNA, 15 bp, Homo sapiens
taattagcacactta

SEQ ID NO: 8787 - DNA, 15 bp, Homo sapiens
aattagcacacttac

SEQ ID NO: 8788 - DNA, 15 bp, Homo sapiens
attagcacacttact

SEQ ID NO: 8789 - DNA, 15 bp, Homo sapiens
ttagcacacttactt

SEQ ID NO: 8790 - DNA, 15 bp, Homo sapiens
tagcacacttactta

SEQ ID NO: 8791 - DNA, 15 bp, Homo sapiens
agcacacttacttaa

SEQ ID NO: 8792 - DNA, 15 bp, Homo sapiens
gcacacttacttaag

SEQ ID NO: 8793 - DNA, 15 bp, Homo sapiens
cacacttacttaagt

SEQ ID NO: 8794 - DNA, 15 bp, Homo sapiens
acacttacttaagtt

SEQ ID NO: 8795 - DNA, 15 bp, Homo sapiens
cacttacttaagtta

SEQ ID NO: 8796 - DNA, 15 bp, Homo sapiens
acttacttaagttag

SEQ ID NO: 8797 - DNA, 15 bp, Homo sapiens
cttacttaagttaga

SEQ ID NO: 8798 - DNA, 15 bp, Homo sapiens
ttacttaagttagaa

SEQ ID NO: 8799 - DNA, 15 bp, Homo sapiens
tacttaagttagaaa

SEQ ID NO: 8800 - DNA, 15 bp, Homo sapiens
acttaagttagaaag

SEQ ID NO: 8801 - DNA, 15 bp, Homo sapiens
cttaagttagaaagt

SEQ ID NO: 8802 - DNA, 15 bp, Homo sapiens
ttaagttagaaagta

SEQ ID NO: 8803 - DNA, 15 bp, Homo sapiens
taagttagaaagtat

SEQ ID NO: 8804 - DNA, 15 bp, Homo sapiens
aagttagaaagtata

SEQ ID NO: 8805 - DNA, 15 bp, Homo sapiens
agttagaaagtataa

SEQ ID NO: 8806 - DNA, 15 bp, Homo sapiens
gttagaaagtataat

SEQ ID NO: 8807 - DNA, 15 bp, Homo sapiens
ttagaaagtataata

SEQ ID NO: 8808 - DNA, 15 bp, Homo sapiens
tagaaagtataataa

SEQ ID NO: 8809 - DNA, 15 bp, Homo sapiens
agaaagtataataat

SEQ ID NO: 8810 - DNA, 15 bp, Homo sapiens
gaaagtataataatg

SEQ ID NO: 8811 - DNA, 15 bp, Homo sapiens
aaagtataataatgc

SEQ ID NO: 8812 - DNA, 15 bp, Homo sapiens
aagtataataatgcg

SEQ ID NO: 8813 - DNA, 15 bp, Homo sapiens
agtataataatgcgc

SEQ ID NO: 8814 - DNA, 15 bp, Homo sapiens
gtataataatgcgcc

SEQ ID NO: 8815 - DNA, 15 bp, Homo sapiens
tataataatgcgccg

SEQ ID NO: 8816 - DNA, 15 bp, Homo sapiens
ataataatgcgccgg

SEQ ID NO: 8817 - DNA, 15 bp, Homo sapiens
taataatgcgccgga

SEQ ID NO: 8818 - DNA, 15 bp, Homo sapiens
aataatgcgccggac

SEQ ID NO: 8819 - DNA, 15 bp, Homo sapiens
ataatgcgccggacg

SEQ ID NO: 8820 - DNA, 15 bp, Homo sapiens
taatgcgccggacgc

SEQ ID NO: 8821 - DNA, 15 bp, Homo sapiens
aatgcgccggacgcg

SEQ ID NO: 8822 - DNA, 15 bp, Homo sapiens
atgcgccggacgcgg

SEQ ID NO: 8823 - DNA, 15 bp, Homo sapiens
tgcgccggacgcggt

SEQ ID NO: 8824 - DNA, 15 bp, Homo sapiens
gcgccggacgcggta

SEQ ID NO: 8825 - DNA, 15 bp, Homo sapiens
cgccggacgcggtag

SEQ ID NO: 8826 - DNA, 15 bp, Homo sapiens
gccggacgcggtagc

SEQ ID NO: 8827 - DNA, 15 bp, Homo sapiens
ccggacgcggtagct

SEQ ID NO: 8828 - DNA, 15 bp, Homo sapiens
cggacgcggtagctc

SEQ ID NO: 8829 - DNA, 15 bp, Homo sapiens
ggacgcggtagctca

SEQ ID NO: 8830 - DNA, 15 bp, Homo sapiens
gacgcggtagctcac

SEQ ID NO: 8831 - DNA, 15 bp, Homo sapiens
acgcggtagctcacg

SEQ ID NO: 8832 - DNA, 15 bp, Homo sapiens
cgcggtagctcacgc

SEQ ID NO: 8833 - DNA, 15 bp, Homo sapiens
gcggtagctcacgcc

SEQ ID NO: 8834 - DNA, 15 bp, Homo sapiens
cggtagctcacgcct

SEQ ID NO: 8835 - DNA, 15 bp, Homo sapiens
ggtagctcacgcctg

SEQ ID NO: 8836 - DNA, 15 bp, Homo sapiens
gtagctcacgcctgt

SEQ ID NO: 8837 - DNA, 15 bp, Homo sapiens
tagctcacgcctgta

SEQ ID NO: 8838 - DNA, 15 bp, Homo sapiens
cactttgggaggcca

SEQ ID NO: 8839 - DNA, 15 bp, Homo sapiens
actttgggaggccaa

SEQ ID NO: 8840 - DNA, 15 bp, Homo sapiens
ctttgggaggccaag

SEQ ID NO: 8841 - DNA, 15 bp, Homo sapiens
tttgggaggccaagg

SEQ ID NO: 8842 - DNA, 15 bp, Homo sapiens
ttgggaggccaaggt

SEQ ID NO: 8843 - DNA, 15 bp, Homo sapiens
tgggaggccaaggtg

SEQ ID NO: 8844 - DNA, 15 bp, Homo sapiens
gggaggccaaggtgg

SEQ ID NO: 8845 - DNA, 15 bp, Homo sapiens
ggaggccaaggtggg

SEQ ID NO: 8846 - DNA, 15 bp, Homo sapiens
gaggccaaggtgggc

SEQ ID NO: 8847 - DNA, 15 bp, Homo sapiens
aggccaaggtgggcg

SEQ ID NO: 8848 - DNA, 15 bp, Homo sapiens
ggccaaggtgggcgg

SEQ ID NO: 8849 - DNA, 15 bp, Homo sapiens
gccaaggtgggcgga

SEQ ID NO: 8850 - DNA, 15 bp, Homo sapiens
ccaaggtgggcggat

SEQ ID NO: 8851 - DNA, 15 bp, Homo sapiens
caaggtgggcggatc

SEQ ID NO: 8852 - DNA, 15 bp, Homo sapiens
aaggtgggcggatca

SEQ ID NO: 8853 - DNA, 15 bp, Homo sapiens
aggtgggcggatcac

SEQ ID NO: 8854 - DNA, 15 bp, Homo sapiens
ggtgggcggatcaca

SEQ ID NO: 8855 - DNA, 15 bp, Homo sapiens
gtgggcggatcacaa

SEQ ID NO: 8856 - DNA, 15 bp, Homo sapiens
tgggcggatcacaag

SEQ ID NO: 8857 - DNA, 15 bp, Homo sapiens
cacggtgaaacccca

SEQ ID NO: 8858 - DNA, 15 bp, Homo sapiens
acggtgaaaccccat

SEQ ID NO: 8859 - DNA, 15 bp, Homo sapiens
cggtgaaaccccatc

SEQ ID NO: 8860 - DNA, 15 bp, Homo sapiens
accccatctctactg

SEQ ID NO: 8861 - DNA, 15 bp, Homo sapiens
ccccatctctactga

SEQ ID NO: 8862 - DNA, 15 bp, Homo sapiens
cccatctctactgaa

SEQ ID NO: 8863 - DNA, 15 bp, Homo sapiens
ccatctctactgaaa

SEQ ID NO: 8864 - DNA, 15 bp, Homo sapiens
catctctactgaaaa

SEQ ID NO: 8865 - DNA, 15 bp, Homo sapiens
atctctactgaaaat

SEQ ID NO: 8866 - DNA, 15 bp, Homo sapiens
tctctactgaaaata

SEQ ID NO: 8867 - DNA, 15 bp, Homo sapiens
ctctactgaaaatac

SEQ ID NO: 8868 - DNA, 15 bp, Homo sapiens
tctactgaaaataca

SEQ ID NO: 8869 - DNA, 15 bp, Homo sapiens
ctactgaaaatacaa

SEQ ID NO: 8870 - DNA, 15 bp, Homo sapiens
tactgaaaatacaaa

SEQ ID NO: 8871 - DNA, 15 bp, Homo sapiens
actgaaaatacaaaa

SEQ ID NO: 8872 - DNA, 15 bp, Homo sapiens
ctgaaaatacaaaaa

SEQ ID NO: 8873 - DNA, 15 bp, Homo sapiens
tgaaaatacaaaaaa

SEQ ID NO: 8874 - DNA, 15 bp, Homo sapiens
gaaaatacaaaaaaa

SEQ ID NO: 8875 - DNA, 15 bp, Homo sapiens
aaaatacaaaaaaat

SEQ ID NO: 8876 - DNA, 15 bp, Homo sapiens
aaatacaaaaaaatt

SEQ ID NO: 8877 - DNA, 15 bp, Homo sapiens
aatacaaaaaaattt

SEQ ID NO: 8878 - DNA, 15 bp, Homo sapiens
atacaaaaaaatttg

SEQ ID NO: 8879 - DNA, 15 bp, Homo sapiens
tacaaaaaaatttgc

SEQ ID NO: 8880 - DNA, 15 bp, Homo sapiens
acaaaaaaatttgcc

SEQ ID NO: 8881 - DNA, 15 bp, Homo sapiens
caaaaaaatttgccg

SEQ ID NO: 8882 - DNA, 15 bp, Homo sapiens
aaaaaaatttgccgg

SEQ ID NO: 8883 - DNA, 15 bp, Homo sapiens
aaaaaatttgccggg

SEQ ID NO: 8884 - DNA, 15 bp, Homo sapiens
aaaaatttgccgggc

SEQ ID NO: 8885 - DNA, 15 bp, Homo sapiens
aaaatttgccgggcg

SEQ ID NO: 8886 - DNA, 15 bp, Homo sapiens
aaatttgccgggcgt

SEQ ID NO: 8887 - DNA, 15 bp, Homo sapiens
aatttgccgggcgtg

SEQ ID NO: 8888 - DNA, 15 bp, Homo sapiens
atttgccgggcgtga

SEQ ID NO: 8889 - DNA, 15 bp, Homo sapiens
tttgccgggcgtgat

SEQ ID NO: 8890 - DNA, 15 bp, Homo sapiens
ttgccgggcgtgatg

SEQ ID NO: 8891 - DNA, 15 bp, Homo sapiens
tgccgggcgtgatgg

SEQ ID NO: 8892 - DNA, 15 bp, Homo sapiens
gccgggcgtgatggc

SEQ ID NO: 8893 - DNA, 15 bp, Homo sapiens
ccgggcgtgatggcg

SEQ ID NO: 8894 - DNA, 15 bp, Homo sapiens
cgggcgtgatggcgg

SEQ ID NO: 8895 - DNA, 15 bp, Homo sapiens
gggcgtgatggcggg

SEQ ID NO: 8896 - DNA, 15 bp, Homo sapiens
ggcgtgatggcgggc

SEQ ID NO: 8897 - DNA, 15 bp, Homo sapiens
gcgtgatggcgggca

SEQ ID NO: 8898 - DNA, 15 bp, Homo sapiens
cgtgatggcgggcac

SEQ ID NO: 8899 - DNA, 15 bp, Homo sapiens
gtgatggcgggcacc

SEQ ID NO: 8900 - DNA, 15 bp, Homo sapiens
tgatggcgggcacct

SEQ ID NO: 8901 - DNA, 15 bp, Homo sapiens
gatggcgggcacctg

SEQ ID NO: 8902 - DNA, 15 bp, Homo sapiens
atggcgggcacctgt

SEQ ID NO: 8903 - DNA, 15 bp, Homo sapiens
tggcgggcacctgta

SEQ ID NO: 8904 - DNA, 15 bp, Homo sapiens
ggcgggcacctgtag

SEQ ID NO: 8905 - DNA, 15 bp, Homo sapiens
gcgggcacctgtagt

SEQ ID NO: 8906 - DNA, 15 bp, Homo sapiens
cgggcacctgtagtc

SEQ ID NO: 8907 - DNA, 15 bp, Homo sapiens
tgaggcaggaggatg

SEQ ID NO: 8908 - DNA, 15 bp, Homo sapiens
gaggcaggaggatgg

SEQ ID NO: 8909 - DNA, 15 bp, Homo sapiens
aggcaggaggatggt

SEQ ID NO: 8910 - DNA, 15 bp, Homo sapiens
ggcaggaggatggtg

SEQ ID NO: 8911 - DNA, 15 bp, Homo sapiens
gcaggaggatggtgt

SEQ ID NO: 8912 - DNA, 15 bp, Homo sapiens
caggaggatggtgtg

SEQ ID NO: 8913 - DNA, 15 bp, Homo sapiens
aggaggatggtgtga

SEQ ID NO: 8914 - DNA, 15 bp, Homo sapiens
ggaggatggtgtgaa

SEQ ID NO: 8915 - DNA, 15 bp, Homo sapiens
gaggatggtgtgaac

SEQ ID NO: 8916 - DNA, 15 bp, Homo sapiens
aggatggtgtgaacc

SEQ ID NO: 8917 - DNA, 15 bp, Homo sapiens
ggatggtgtgaaccc

SEQ ID NO: 8918 - DNA, 15 bp, Homo sapiens
gatggtgtgaacccc

SEQ ID NO: 8919 - DNA, 15 bp, Homo sapiens
atggtgtgaaccccg

SEQ ID NO: 8920 - DNA, 15 bp, Homo sapiens
tggtgtgaaccccgg

SEQ ID NO: 8921 - DNA, 15 bp, Homo sapiens
ggtgtgaaccccgga

SEQ ID NO: 8922 - DNA, 15 bp, Homo sapiens
gtgtgaaccccggag

SEQ ID NO: 8923 - DNA, 15 bp, Homo sapiens
tgtgaaccccggagg

SEQ ID NO: 8924 - DNA, 15 bp, Homo sapiens
gtgaaccccggaggc

SEQ ID NO: 8925 - DNA, 15 bp, Homo sapiens
tgaaccccggaggca

SEQ ID NO: 8926 - DNA, 15 bp, Homo sapiens
gaaccccggaggcag

SEQ ID NO: 8927 - DNA, 15 bp, Homo sapiens
aaccccggaggcaga

SEQ ID NO: 8928 - DNA, 15 bp, Homo sapiens
accccggaggcagag

SEQ ID NO: 8929 - DNA, 15 bp, Homo sapiens
ccccggaggcagagc

SEQ ID NO: 8930 - DNA, 15 bp, Homo sapiens
cccggaggcagagct

SEQ ID NO: 8931 - DNA, 15 bp, Homo sapiens
ccggaggcagagctt

SEQ ID NO: 8932 - DNA, 15 bp, Homo sapiens
cggaggcagagcttg

SEQ ID NO: 8933 - DNA, 15 bp, Homo sapiens
ggaggcagagcttgc

SEQ ID NO: 8934 - DNA, 15 bp, Homo sapiens
gaggcagagcttgca

SEQ ID NO: 8935 - DNA, 15 bp, Homo sapiens
aggcagagcttgcag

SEQ ID NO: 8936 - DNA, 15 bp, Homo sapiens
ggcagagcttgcagt

SEQ ID NO: 8937 - DNA, 15 bp, Homo sapiens
gagcttgcagtgagt

SEQ ID NO: 8938 - DNA, 15 bp, Homo sapiens
agcttgcagtgagtc

SEQ ID NO: 8939 - DNA, 15 bp, Homo sapiens
gcttgcagtgagtca

SEQ ID NO: 8940 - DNA, 15 bp, Homo sapiens
cttgcagtgagtcaa

SEQ ID NO: 8941 - DNA, 15 bp, Homo sapiens
ttgcagtgagtcaag

SEQ ID NO: 8942 - DNA, 15 bp, Homo sapiens
tgcagtgagtcaaga

SEQ ID NO: 8943 - DNA, 15 bp, Homo sapiens
gcagtgagtcaagat

SEQ ID NO: 8944 - DNA, 15 bp, Homo sapiens
cagtgagtcaagatc

SEQ ID NO: 8945 - DNA, 15 bp, Homo sapiens
agtgagtcaagatcg

SEQ ID NO: 8946 - DNA, 15 bp, Homo sapiens
gtgagtcaagatcgt

SEQ ID NO: 8947 - DNA, 15 bp, Homo sapiens
tgagtcaagatcgtg

SEQ ID NO: 8948 - DNA, 15 bp, Homo sapiens
gagtcaagatcgtgc

SEQ ID NO: 8949 - DNA, 15 bp, Homo sapiens
agtcaagatcgtgcc

SEQ ID NO: 8950 - DNA, 15 bp, Homo sapiens
gtcaagatcgtgcca

SEQ ID NO: 8951 - DNA, 15 bp, Homo sapiens
tcaagatcgtgccac

SEQ ID NO: 8952 - DNA, 15 bp, Homo sapiens
caagatcgtgccact

SEQ ID NO: 8953 - DNA, 15 bp, Homo sapiens
aagatcgtgccactg

SEQ ID NO: 8954 - DNA, 15 bp, Homo sapiens
agatcgtgccactgc

SEQ ID NO: 8955 - DNA, 15 bp, Homo sapiens
gatcgtgccactgca

SEQ ID NO: 8956 - DNA, 15 bp, Homo sapiens
atcgtgccactgcac

SEQ ID NO: 8957 - DNA, 15 bp, Homo sapiens
tcgtgccactgcact

SEQ ID NO: 8958 - DNA, 15 bp, Homo sapiens
cgtgccactgcactc

SEQ ID NO: 8959 - DNA, 15 bp, Homo sapiens
gccactgcactccaa

SEQ ID NO: 8960 - DNA, 15 bp, Homo sapiens
ccactgcactccaac

SEQ ID NO: 8961 - DNA, 15 bp, Homo sapiens
cactgcactccaacc

SEQ ID NO: 8962 - DNA, 15 bp, Homo sapiens
actgcactccaacct

SEQ ID NO: 8963 - DNA, 15 bp, Homo sapiens
ctgcactccaacctg

SEQ ID NO: 8964 - DNA, 15 bp, Homo sapiens
tgcactccaacctgg

SEQ ID NO: 8965 - DNA, 15 bp, Homo sapiens
gcactccaacctggg

SEQ ID NO: 8966 - DNA, 15 bp, Homo sapiens
cactccaacctgggc

SEQ ID NO: 8967 - DNA, 15 bp, Homo sapiens
actccaacctgggcg

SEQ ID NO: 8968 - DNA, 15 bp, Homo sapiens
ctccaacctgggcga

SEQ ID NO: 8969 - DNA, 15 bp, Homo sapiens
tccaacctgggcgac

SEQ ID NO: 8970 - DNA, 15 bp, Homo sapiens
ccaacctgggcgaca

SEQ ID NO: 8971 - DNA, 15 bp, Homo sapiens
caacctgggcgacag

SEQ ID NO: 8972 - DNA, 15 bp, Homo sapiens
aacctgggcgacaga

SEQ ID NO: 8973 - DNA, 15 bp, Homo sapiens
acctgggcgacagaa

SEQ ID NO: 8974 - DNA, 15 bp, Homo sapiens
cctgggcgacagaat

SEQ ID NO: 8975 - DNA, 15 bp, Homo sapiens
ctgggcgacagaatg

SEQ ID NO: 8976 - DNA, 15 bp, Homo sapiens
tgggcgacagaatga

SEQ ID NO: 8977 - DNA, 15 bp, Homo sapiens
gggcgacagaatgag

SEQ ID NO: 8978 - DNA, 15 bp, Homo sapiens
ggcgacagaatgaga

SEQ ID NO: 8979 - DNA, 15 bp, Homo sapiens
gcgacagaatgagac

SEQ ID NO: 8980 - DNA, 15 bp, Homo sapiens
cgacagaatgagact

SEQ ID NO: 8981 - DNA, 15 bp, Homo sapiens
atgagactccatctc

SEQ ID NO: 8982 - DNA, 15 bp, Homo sapiens
gactccatctcaaac

SEQ ID NO: 8983 - DNA, 15 bp, Homo sapiens
actccatctcaaaca

SEQ ID NO: 8984 - DNA, 15 bp, Homo sapiens
ctccatctcaaacaa

SEQ ID NO: 8985 - DNA, 15 bp, Homo sapiens
tccatctcaaacaaa

SEQ ID NO: 8986 - DNA, 15 bp, Homo sapiens
ccatctcaaacaaaa

SEQ ID NO: 8987 - DNA, 15 bp, Homo sapiens
catctcaaacaaaaa

SEQ ID NO: 8988 - DNA, 15 bp, Homo sapiens
atctcaaacaaaaaa

SEQ ID NO: 8989 - DNA, 15 bp, Homo sapiens
tctcaaacaaaaaaa

SEQ ID NO: 8990 - DNA, 15 bp, Homo sapiens
ctcaaacaaaaaaac

SEQ ID NO: 8991 - DNA, 15 bp, Homo sapiens
tcaaacaaaaaaaca

SEQ ID NO: 8992 - DNA, 15 bp, Homo sapiens
caaacaaaaaaacaa

SEQ ID NO: 8993 - DNA, 15 bp, Homo sapiens
aaacaaaaaaacaaa

SEQ ID NO: 8994 - DNA, 15 bp, Homo sapiens
aacaaaaaaacaaaa

SEQ ID NO: 8995 - DNA, 15 bp, Homo sapiens
acaaaaaaacaaaac

SEQ ID NO: 8996 - DNA, 15 bp, Homo sapiens
caaaaaaacaaaaca

SEQ ID NO: 8997 - DNA, 15 bp, Homo sapiens
aaaaaaacaaaacaa

SEQ ID NO: 8998 - DNA, 15 bp, Homo sapiens
aaaaaacaaaacaaa

SEQ ID NO: 8999 - DNA, 15 bp, Homo sapiens
aaaaacaaaacaaaa

SEQ ID NO: 9000 - DNA, 15 bp, Homo sapiens
caaaacaaaaaaaag

SEQ ID NO: 9001 - DNA, 15 bp, Homo sapiens
aaaacaaaaaaaagt

SEQ ID NO: 9002 - DNA, 15 bp, Homo sapiens
aaacaaaaaaaagtg

SEQ ID NO: 9003 - DNA, 15 bp, Homo sapiens
aacaaaaaaaagtgt

SEQ ID NO: 9004 - DNA, 15 bp, Homo sapiens
acaaaaaaaagtgta

SEQ ID NO: 9005 - DNA, 15 bp, Homo sapiens
caaaaaaaagtgtaa

SEQ ID NO: 9006 - DNA, 15 bp, Homo sapiens
aaaaaaaagtgtaat

SEQ ID NO: 9007 - DNA, 15 bp, Homo sapiens
aaaaaaagtgtaata

SEQ ID NO: 9008 - DNA, 15 bp, Homo sapiens
aaaaaagtgtaataa

SEQ ID NO: 9009 - DNA, 15 bp, Homo sapiens
aaaaagtgtaataat

SEQ ID NO: 9010 - DNA, 15 bp, Homo sapiens
aaaagtgtaataata

SEQ ID NO: 9011 - DNA, 15 bp, Homo sapiens
aaagtgtaataataa

SEQ ID NO: 9012 - DNA, 15 bp, Homo sapiens
aagtgtaataataat

SEQ ID NO: 9013 - DNA, 15 bp, Homo sapiens
agtgtaataataatt

SEQ ID NO: 9014 - DNA, 15 bp, Homo sapiens
gtgtaataataattt

SEQ ID NO: 9015 - DNA, 15 bp, Homo sapiens
tgtaataataattta

SEQ ID NO: 9016 - DNA, 15 bp, Homo sapiens
gtaataataatttat

SEQ ID NO: 9017 - DNA, 15 bp, Homo sapiens
taataataatttatc

SEQ ID NO: 9018 - DNA, 15 bp, Homo sapiens
aataataatttatca

SEQ ID NO: 9019 - DNA, 15 bp, Homo sapiens
ataataatttatcat

SEQ ID NO: 9020 - DNA, 15 bp, Homo sapiens
taataatttatcatt

SEQ ID NO: 9021 - DNA, 15 bp, Homo sapiens
aataatttatcatta

SEQ ID NO: 9022 - DNA, 15 bp, Homo sapiens
ataatttatcattag

SEQ ID NO: 9023 - DNA, 15 bp, Homo sapiens
taatttatcattagc

SEQ ID NO: 9024 - DNA, 15 bp, Homo sapiens
aatttatcattagct

SEQ ID NO: 9025 - DNA, 15 bp, Homo sapiens
atttatcattagctg

SEQ ID NO: 9026 - DNA, 15 bp, Homo sapiens
tttatcattagctgg

SEQ ID NO: 9027 - DNA, 15 bp, Homo sapiens
ttatcattagctgga

SEQ ID NO: 9028 - DNA, 15 bp, Homo sapiens
tatcattagctggat

SEQ ID NO: 9029 - DNA, 15 bp, Homo sapiens
atcattagctggatg

SEQ ID NO: 9030 - DNA, 15 bp, Homo sapiens
tcattagctggatga

SEQ ID NO: 9031 - DNA, 15 bp, Homo sapiens
cattagctggatgat

SEQ ID NO: 9032 - DNA, 15 bp, Homo sapiens
attagctggatgata

SEQ ID NO: 9033 - DNA, 15 bp, Homo sapiens
ttagctggatgatat

SEQ ID NO: 9034 - DNA, 15 bp, Homo sapiens
tagctggatgatatg

SEQ ID NO: 9035 - DNA, 15 bp, Homo sapiens
agctggatgatatgc

SEQ ID NO: 9036 - DNA, 15 bp, Homo sapiens
gctggatgatatgct

SEQ ID NO: 9037 - DNA, 15 bp, Homo sapiens
ctggatgatatgctg

SEQ ID NO: 9038 - DNA, 15 bp, Homo sapiens
tggatgatatgctgt

SEQ ID NO: 9039 - DNA, 15 bp, Homo sapiens
ggatgatatgctgtt

SEQ ID NO: 9040 - DNA, 15 bp, Homo sapiens
gatgatatgctgttg

SEQ ID NO: 9041 - DNA, 15 bp, Homo sapiens
atgatatgctgttgt

SEQ ID NO: 9042 - DNA, 15 bp, Homo sapiens
tgatatgctgttgtt

SEQ ID NO: 9043 - DNA, 15 bp, Homo sapiens
gatatgctgttgttt

SEQ ID NO: 9044 - DNA, 15 bp, Homo sapiens
atatgctgttgtttc

SEQ ID NO: 9045 - DNA, 15 bp, Homo sapiens
tatgctgttgtttcc

SEQ ID NO: 9046 - DNA, 15 bp, Homo sapiens
atgctgttgtttccc

SEQ ID NO: 9047 - DNA, 15 bp, Homo sapiens
tgctgttgtttccca

SEQ ID NO: 9048 - DNA, 15 bp, Homo sapiens
gctgttgtttcccat

SEQ ID NO: 9049 - DNA, 15 bp, Homo sapiens
ctgttgtttcccatg

SEQ ID NO: 9050 - DNA, 15 bp, Homo sapiens
tgttgtttcccatgt

SEQ ID NO: 9051 - DNA, 15 bp, Homo sapiens
gttgtttcccatgtc

SEQ ID NO: 9052 - DNA, 15 bp, Homo sapiens
ttgtttcccatgtca

SEQ ID NO: 9053 - DNA, 15 bp, Homo sapiens
tgtttcccatgtcac

SEQ ID NO: 9054 - DNA, 15 bp, Homo sapiens
gtttcccatgtcacc

SEQ ID NO: 9055 - DNA, 15 bp, Homo sapiens
tttcccatgtcacct

SEQ ID NO: 9056 - DNA, 15 bp, Homo sapiens
ttcccatgtcacctg

SEQ ID NO: 9057 - DNA, 15 bp, Homo sapiens
tcccatgtcacctgt

SEQ ID NO: 9058 - DNA, 15 bp, Homo sapiens
cccatgtcacctgta

SEQ ID NO: 9059 - DNA, 15 bp, Homo sapiens
ccatgtcacctgtat

SEQ ID NO: 9060 - DNA, 15 bp, Homo sapiens
catgtcacctgtata

SEQ ID NO: 9061 - DNA, 15 bp, Homo sapiens
atgtcacctgtataa

SEQ ID NO: 9062 - DNA, 15 bp, Homo sapiens
tgtcacctgtataag

SEQ ID NO: 9063 - DNA, 15 bp, Homo sapiens
gtcacctgtataaga

SEQ ID NO: 9064 - DNA, 15 bp, Homo sapiens
tcacctgtataagat

SEQ ID NO: 9065 - DNA, 15 bp, Homo sapiens
cacctgtataagata

SEQ ID NO: 9066 - DNA, 15 bp, Homo sapiens
acctgtataagatat

SEQ ID NO: 9067 - DNA, 15 bp, Homo sapiens
cctgtataagatatg

SEQ ID NO: 9068 - DNA, 15 bp, Homo sapiens
ctgtataagatatgt

SEQ ID NO: 9069 - DNA, 15 bp, Homo sapiens
tgtataagatatgta

SEQ ID NO: 9070 - DNA, 15 bp, Homo sapiens
gtataagatatgtaa

SEQ ID NO: 9071 - DNA, 15 bp, Homo sapiens
tataagatatgtaaa

SEQ ID NO: 9072 - DNA, 15 bp, Homo sapiens
ataagatatgtaaaa

SEQ ID NO: 9073 - DNA, 15 bp, Homo sapiens
taagatatgtaaaat

SEQ ID NO: 9074 - DNA, 15 bp, Homo sapiens
aagatatgtaaaata

SEQ ID NO: 9075 - DNA, 15 bp, Homo sapiens
agatatgtaaaataa

SEQ ID NO: 9076 - DNA, 15 bp, Homo sapiens
gatatgtaaaataag

SEQ ID NO: 9077 - DNA, 15 bp, Homo sapiens
atatgtaaaataaga

SEQ ID NO: 9078 - DNA, 15 bp, Homo sapiens
tatgtaaaataagaa

SEQ ID NO: 9079 - DNA, 15 bp, Homo sapiens
atgtaaaataagaac

SEQ ID NO: 9080 - DNA, 15 bp, Homo sapiens
tgtaaaataagaaca

SEQ ID NO: 9081 - DNA, 15 bp, Homo sapiens
gtaaaataagaacac

SEQ ID NO: 9082 - DNA, 15 bp, Homo sapiens
taaaataagaacaca

SEQ ID NO: 9083 - DNA, 15 bp, Homo sapiens
aaaataagaacacat

SEQ ID NO: 9084 - DNA, 15 bp, Homo sapiens
aaataagaacacatt

SEQ ID NO: 9085 - DNA, 15 bp, Homo sapiens
aataagaacacatta

SEQ ID NO: 9086 - DNA, 15 bp, Homo sapiens
ataagaacacattat

SEQ ID NO: 9087 - DNA, 15 bp, Homo sapiens
taagaacacattatt

SEQ ID NO: 9088 - DNA, 15 bp, Homo sapiens
aagaacacattattt

SEQ ID NO: 9089 - DNA, 15 bp, Homo sapiens
agaacacattattta

SEQ ID NO: 9090 - DNA, 15 bp, Homo sapiens
gaacacattatttac

SEQ ID NO: 9091 - DNA, 15 bp, Homo sapiens
aacacattatttaca

SEQ ID NO: 9092 - DNA, 15 bp, Homo sapiens
acacattatttacat

SEQ ID NO: 9093 - DNA, 15 bp, Homo sapiens
cacattatttacatc

SEQ ID NO: 9094 - DNA, 15 bp, Homo sapiens
acattatttacatct

SEQ ID NO: 9095 - DNA, 15 bp, Homo sapiens
cattatttacatcta

SEQ ID NO: 9096 - DNA, 15 bp, Homo sapiens
attatttacatctaa

SEQ ID NO: 9097 - DNA, 15 bp, Homo sapiens
ttatttacatctaat

SEQ ID NO: 9098 - DNA, 15 bp, Homo sapiens
tatttacatctaata

SEQ ID NO: 9099 - DNA, 15 bp, Homo sapiens
atttacatctaatat

SEQ ID NO: 9100 - DNA, 15 bp, Homo sapiens
tttacatctaatata

SEQ ID NO: 9101 - DNA, 15 bp, Homo sapiens
ttacatctaatatag

SEQ ID NO: 9102 - DNA, 15 bp, Homo sapiens
tacatctaatataga

SEQ ID NO: 9103 - DNA, 15 bp, Homo sapiens
acatctaatatagat

SEQ ID NO: 9104 - DNA, 15 bp, Homo sapiens
catctaatatagata

SEQ ID NO: 9105 - DNA, 15 bp, Homo sapiens
atctaatatagataa

SEQ ID NO: 9106 - DNA, 15 bp, Homo sapiens
tctaatatagataaa

SEQ ID NO: 9107 - DNA, 15 bp, Homo sapiens
ctaatatagataaaa

SEQ ID NO: 9108 - DNA, 15 bp, Homo sapiens
taatatagataaaat

SEQ ID NO: 9109 - DNA, 15 bp, Homo sapiens
aatatagataaaatc

SEQ ID NO: 9110 - DNA, 15 bp, Homo sapiens
atatagataaaatcc

SEQ ID NO: 9111 - DNA, 15 bp, Homo sapiens
tatagataaaatcct

SEQ ID NO: 9112 - DNA, 15 bp, Homo sapiens
atagataaaatcctg

SEQ ID NO: 9113 - DNA, 15 bp, Homo sapiens
tagataaaatcctga

SEQ ID NO: 9114 - DNA, 15 bp, Homo sapiens
agataaaatcctgag

SEQ ID NO: 9115 - DNA, 15 bp, Homo sapiens
gataaaatcctgagg

SEQ ID NO: 9116 - DNA, 15 bp, Homo sapiens
ataaaatcctgaggc

SEQ ID NO: 9117 - DNA, 15 bp, Homo sapiens
taaaatcctgaggcg

SEQ ID NO: 9118 - DNA, 15 bp, Homo sapiens
aaaatcctgaggcgc

SEQ ID NO: 9119 - DNA, 15 bp, Homo sapiens
aaatcctgaggcgct

SEQ ID NO: 9120 - DNA, 15 bp, Homo sapiens
aatcctgaggcgctc

SEQ ID NO: 9121 - DNA, 15 bp, Homo sapiens
atcctgaggcgctct

SEQ ID NO: 9122 - DNA, 15 bp, Homo sapiens
tcctgaggcgctctc

SEQ ID NO: 9123 - DNA, 15 bp, Homo sapiens
cctgaggcgctctca

SEQ ID NO: 9124 - DNA, 15 bp, Homo sapiens
ctgaggcgctctcag

SEQ ID NO: 9125 - DNA, 15 bp, Homo sapiens
tgaggcgctctcaga

SEQ ID NO: 9126 - DNA, 15 bp, Homo sapiens
gaggcgctctcagat

SEQ ID NO: 9127 - DNA, 15 bp, Homo sapiens
aggcgctctcagatt

SEQ ID NO: 9128 - DNA, 15 bp, Homo sapiens
ggcgctctcagattg

SEQ ID NO: 9129 - DNA, 15 bp, Homo sapiens
gcgctctcagattgt

SEQ ID NO: 9130 - DNA, 15 bp, Homo sapiens
cgctctcagattgtt

SEQ ID NO: 9131 - DNA, 15 bp, Homo sapiens
gctctcagattgttt

SEQ ID NO: 9132 - DNA, 15 bp, Homo sapiens
ctctcagattgtttt

SEQ ID NO: 9133 - DNA, 15 bp, Homo sapiens
tctcagattgttttg

SEQ ID NO: 9134 - DNA, 15 bp, Homo sapiens
ctcagattgttttgt

SEQ ID NO: 9135 - DNA, 15 bp, Homo sapiens
tcagattgttttgta

SEQ ID NO: 9136 - DNA, 15 bp, Homo sapiens
cagattgttttgtag

SEQ ID NO: 9137 - DNA, 15 bp, Homo sapiens
agattgttttgtaga

SEQ ID NO: 9138 - DNA, 15 bp, Homo sapiens
gattgttttgtagag

SEQ ID NO: 9139 - DNA, 15 bp, Homo sapiens
attgttttgtagagt

SEQ ID NO: 9140 - DNA, 15 bp, Homo sapiens
ttgttttgtagagtt

SEQ ID NO: 9141 - DNA, 15 bp, Homo sapiens
tgttttgtagagttc

SEQ ID NO: 9142 - DNA, 15 bp, Homo sapiens
gttttgtagagttca

SEQ ID NO: 9143 - DNA, 15 bp, Homo sapiens
ttttgtagagttcaa

SEQ ID NO: 9144 - DNA, 15 bp, Homo sapiens
tttgtagagttcaaa

SEQ ID NO: 9145 - DNA, 15 bp, Homo sapiens
ttgtagagttcaaat

SEQ ID NO: 9146 - DNA, 15 bp, Homo sapiens
tgtagagttcaaatg

SEQ ID NO: 9147 - DNA, 15 bp, Homo sapiens
gtagagttcaaatgt

SEQ ID NO: 9148 - DNA, 15 bp, Homo sapiens
tagagttcaaatgta

SEQ ID NO: 9149 - DNA, 15 bp, Homo sapiens
agagttcaaatgtaa

SEQ ID NO: 9150 - DNA, 15 bp, Homo sapiens
gagttcaaatgtaaa

SEQ ID NO: 9151 - DNA, 15 bp, Homo sapiens
agttcaaatgtaaat

SEQ ID NO: 9152 - DNA, 15 bp, Homo sapiens
gttcaaatgtaaata

SEQ ID NO: 9153 - DNA, 15 bp, Homo sapiens
ttcaaatgtaaatat

SEQ ID NO: 9154 - DNA, 15 bp, Homo sapiens
tcaaatgtaaatatt

SEQ ID NO: 9155 - DNA, 15 bp, Homo sapiens
caaatgtaaatattg

SEQ ID NO: 9156 - DNA, 15 bp, Homo sapiens
aaatgtaaatattgt

SEQ ID NO: 9157 - DNA, 15 bp, Homo sapiens
aatgtaaatattgtt

SEQ ID NO: 9158 - DNA, 15 bp, Homo sapiens
atgtaaatattgttt

SEQ ID NO: 9159 - DNA, 15 bp, Homo sapiens
tgtaaatattgtttt

SEQ ID NO: 9160 - DNA, 15 bp, Homo sapiens
gtaaatattgttttc

SEQ ID NO: 9161 - DNA, 15 bp, Homo sapiens
taaatattgttttca

SEQ ID NO: 9162 - DNA, 15 bp, Homo sapiens
aaatattgttttcat

SEQ ID NO: 9163 - DNA, 15 bp, Homo sapiens
aatattgttttcatt

SEQ ID NO: 9164 - DNA, 15 bp, Homo sapiens
atattgttttcattt

SEQ ID NO: 9165 - DNA, 15 bp, Homo sapiens
tattgttttcattta

SEQ ID NO: 9166 - DNA, 15 bp, Homo sapiens
attgttttcatttat

SEQ ID NO: 9167 - DNA, 15 bp, Homo sapiens
ttgttttcatttatg

SEQ ID NO: 9168 - DNA, 15 bp, Homo sapiens
tgttttcatttatgg

SEQ ID NO: 9169 - DNA, 15 bp, Homo sapiens
gttttcatttatggt

SEQ ID NO: 9170 - DNA, 15 bp, Homo sapiens
ttttcatttatggtc

SEQ ID NO: 9171 - DNA, 15 bp, Homo sapiens
tttcatttatggtcc

SEQ ID NO: 9172 - DNA, 15 bp, Homo sapiens
ttcatttatggtcct

SEQ ID NO: 9173 - DNA, 15 bp, Homo sapiens
tcatttatggtcctt

SEQ ID NO: 9174 - DNA, 15 bp, Homo sapiens
catttatggtccttt

SEQ ID NO: 9175 - DNA, 15 bp, Homo sapiens
atttatggtcctttt

SEQ ID NO: 9176 - DNA, 15 bp, Homo sapiens
tttatggtccttttg

SEQ ID NO: 9177 - DNA, 15 bp, Homo sapiens
ttatggtccttttgg

SEQ ID NO: 9178 - DNA, 15 bp, Homo sapiens
tatggtccttttggt

SEQ ID NO: 9179 - DNA, 15 bp, Homo sapiens
atggtccttttggtt

SEQ ID NO: 9180 - DNA, 15 bp, Homo sapiens
tggtccttttggtta

SEQ ID NO: 9181 - DNA, 15 bp, Homo sapiens
ggtccttttggttat

SEQ ID NO: 9182 - DNA, 15 bp, Homo sapiens
gtccttttggttata

SEQ ID NO: 9183 - DNA, 15 bp, Homo sapiens
tccttttggttataa

SEQ ID NO: 9184 - DNA, 15 bp, Homo sapiens
ccttttggttataag

SEQ ID NO: 9185 - DNA, 15 bp, Homo sapiens
cttttggttataagt

SEQ ID NO: 9186 - DNA, 15 bp, Homo sapiens
ttttggttataagta

SEQ ID NO: 9187 - DNA, 15 bp, Homo sapiens
tttggttataagtaa

SEQ ID NO: 9188 - DNA, 15 bp, Homo sapiens
ttggttataagtaac

SEQ ID NO: 9189 - DNA, 15 bp, Homo sapiens
tggttataagtaaca

SEQ ID NO: 9190 - DNA, 15 bp, Homo sapiens
ggttataagtaacag

SEQ ID NO: 9191 - DNA, 15 bp, Homo sapiens
gttataagtaacaga

SEQ ID NO: 9192 - DNA, 15 bp, Homo sapiens
ttataagtaacagaa

SEQ ID NO: 9193 - DNA, 15 bp, Homo sapiens
tataagtaacagaaa

SEQ ID NO: 9194 - DNA, 15 bp, Homo sapiens
ataagtaacagaaat

SEQ ID NO: 9195 - DNA, 15 bp, Homo sapiens
taagtaacagaaatc

SEQ ID NO: 9196 - DNA, 15 bp, Homo sapiens
aagtaacagaaatca

SEQ ID NO: 9197 - DNA, 15 bp, Homo sapiens
agtaacagaaatcaa

SEQ ID NO: 9198 - DNA, 15 bp, Homo sapiens
gtaacagaaatcaac

SEQ ID NO: 9199 - DNA, 15 bp, Homo sapiens
taacagaaatcaact

SEQ ID NO: 9200 - DNA, 15 bp, Homo sapiens
aacagaaatcaactc

SEQ ID NO: 9201 - DNA, 15 bp, Homo sapiens
acagaaatcaactct

SEQ ID NO: 9202 - DNA, 15 bp, Homo sapiens
cagaaatcaactcta

SEQ ID NO: 9203 - DNA, 15 bp, Homo sapiens
agaaatcaactctaa

SEQ ID NO: 9204 - DNA, 15 bp, Homo sapiens
gaaatcaactctaaa

SEQ ID NO: 9205 - DNA, 15 bp, Homo sapiens
aaatcaactctaaaa

SEQ ID NO: 9206 - DNA, 15 bp, Homo sapiens
aatcaactctaaaaa

SEQ ID NO: 9207 - DNA, 15 bp, Homo sapiens
atcaactctaaaaag

SEQ ID NO: 9208 - DNA, 15 bp, Homo sapiens
tcaactctaaaaaga

SEQ ID NO: 9209 - DNA, 15 bp, Homo sapiens
caactctaaaaagat

SEQ ID NO: 9210 - DNA, 15 bp, Homo sapiens
aactctaaaaagatt

SEQ ID NO: 9211 - DNA, 15 bp, Homo sapiens
actctaaaaagattt

SEQ ID NO: 9212 - DNA, 15 bp, Homo sapiens
ctctaaaaagatttt

SEQ ID NO: 9213 - DNA, 15 bp, Homo sapiens
tctaaaaagattttt

SEQ ID NO: 9214 - DNA, 15 bp, Homo sapiens
ctaaaaagattttta

SEQ ID NO: 9215 - DNA, 15 bp, Homo sapiens
taaaaagatttttat

SEQ ID NO: 9216 - DNA, 15 bp, Homo sapiens
aaaaagatttttatt

SEQ ID NO: 9217 - DNA, 15 bp, Homo sapiens
aaaagatttttatta

SEQ ID NO: 9218 - DNA, 15 bp, Homo sapiens
aaagatttttattat

SEQ ID NO: 9219 - DNA, 15 bp, Homo sapiens
aagatttttattata

SEQ ID NO: 9220 - DNA, 15 bp, Homo sapiens
agatttttattatag

SEQ ID NO: 9221 - DNA, 15 bp, Homo sapiens
gatttttattatagg

SEQ ID NO: 9222 - DNA, 15 bp, Homo sapiens
atttttattataggt

SEQ ID NO: 9223 - DNA, 15 bp, Homo sapiens
tttttattataggtt

SEQ ID NO: 9224 - DNA, 15 bp, Homo sapiens
ttttattataggtta

SEQ ID NO: 9225 - DNA, 15 bp, Homo sapiens
tttattataggttag

SEQ ID NO: 9226 - DNA, 15 bp, Homo sapiens
ttattataggttaga

SEQ ID NO: 9227 - DNA, 15 bp, Homo sapiens
tattataggttagat

SEQ ID NO: 9228 - DNA, 15 bp, Homo sapiens
attataggttagatt

SEQ ID NO: 9229 - DNA, 15 bp, Homo sapiens
ttataggttagatta

SEQ ID NO: 9230 - DNA, 15 bp, Homo sapiens
tataggttagattat

SEQ ID NO: 9231 - DNA, 15 bp, Homo sapiens
ataggttagattatg

SEQ ID NO: 9232 - DNA, 15 bp, Homo sapiens
taggttagattatgt

SEQ ID NO: 9233 - DNA, 15 bp, Homo sapiens
aggttagattatgtc

SEQ ID NO: 9234 - DNA, 15 bp, Homo sapiens
ggttagattatgtca

SEQ ID NO: 9235 - DNA, 15 bp, Homo sapiens
gttagattatgtcat

SEQ ID NO: 9236 - DNA, 15 bp, Homo sapiens
ttagattatgtcatg

SEQ ID NO: 9237 - DNA, 15 bp, Homo sapiens
tagattatgtcatgg

SEQ ID NO: 9238 - DNA, 15 bp, Homo sapiens
agattatgtcatgga

SEQ ID NO: 9239 - DNA, 15 bp, Homo sapiens
gattatgtcatggaa

SEQ ID NO: 9240 - DNA, 15 bp, Homo sapiens
attatgtcatggaac

SEQ ID NO: 9241 - DNA, 15 bp, Homo sapiens
ttatgtcatggaacc

SEQ ID NO: 9242 - DNA, 15 bp, Homo sapiens
tatgtcatggaacct

SEQ ID NO: 9243 - DNA, 15 bp, Homo sapiens
atgtcatggaacctt

SEQ ID NO: 9244 - DNA, 15 bp, Homo sapiens
tgtcatggaacctta

SEQ ID NO: 9245 - DNA, 15 bp, Homo sapiens
gtcatggaaccttaa

SEQ ID NO: 9246 - DNA, 15 bp, Homo sapiens
tcatggaaccttaag

SEQ ID NO: 9247 - DNA, 15 bp, Homo sapiens
catggaaccttaagg

SEQ ID NO: 9248 - DNA, 15 bp, Homo sapiens
atggaaccttaaggc

SEQ ID NO: 9249 - DNA, 15 bp, Homo sapiens
tggaaccttaaggct

SEQ ID NO: 9250 - DNA, 15 bp, Homo sapiens
ggaaccttaaggctt

SEQ ID NO: 9251 - DNA, 15 bp, Homo sapiens
gaaccttaaggcttg

SEQ ID NO: 9252 - DNA, 15 bp, Homo sapiens
aaccttaaggcttgt

SEQ ID NO: 9253 - DNA, 15 bp, Homo sapiens
accttaaggcttgtc

SEQ ID NO: 9254 - DNA, 15 bp, Homo sapiens
ccttaaggcttgtcc

SEQ ID NO: 9255 - DNA, 15 bp, Homo sapiens
cttaaggcttgtccc

SEQ ID NO: 9256 - DNA, 15 bp, Homo sapiens
ttaaggcttgtccct

SEQ ID NO: 9257 - DNA, 15 bp, Homo sapiens
taaggcttgtccctt

SEQ ID NO: 9258 - DNA, 15 bp, Homo sapiens
aaggcttgtcccttt

SEQ ID NO: 9259 - DNA, 15 bp, Homo sapiens
aggcttgtccctttc

SEQ ID NO: 9260 - DNA, 15 bp, Homo sapiens
ggcttgtccctttct

SEQ ID NO: 9261 - DNA, 15 bp, Homo sapiens
gcttgtccctttcta

SEQ ID NO: 9262 - DNA, 15 bp, Homo sapiens
cttgtccctttctag

SEQ ID NO: 9263 - DNA, 15 bp, Homo sapiens
ttgtccctttctagt

SEQ ID NO: 9264 - DNA, 15 bp, Homo sapiens
tgtccctttctagtt

SEQ ID NO: 9265 - DNA, 15 bp, Homo sapiens
gtccctttctagttc

SEQ ID NO: 9266 - DNA, 15 bp, Homo sapiens
tccctttctagttct

SEQ ID NO: 9267 - DNA, 15 bp, Homo sapiens
ccctttctagttctt

SEQ ID NO: 9268 - DNA, 15 bp, Homo sapiens
cctttctagttcttt

SEQ ID NO: 9269 - DNA, 15 bp, Homo sapiens
ctttctagttctttt

SEQ ID NO: 9270 - DNA, 15 bp, Homo sapiens
tttctagttcttttg

SEQ ID NO: 9271 - DNA, 15 bp, Homo sapiens
ttctagttcttttgt

SEQ ID NO: 9272 - DNA, 15 bp, Homo sapiens
tctagttcttttgtg

SEQ ID NO: 9273 - DNA, 15 bp, Homo sapiens
ctagttcttttgtgt

SEQ ID NO: 9274 - DNA, 15 bp, Homo sapiens
tagttcttttgtgta

SEQ ID NO: 9275 - DNA, 15 bp, Homo sapiens
agttcttttgtgtaa

SEQ ID NO: 9276 - DNA, 15 bp, Homo sapiens
gttcttttgtgtaaa

SEQ ID NO: 9277 - DNA, 15 bp, Homo sapiens
ttcttttgtgtaaag

SEQ ID NO: 9278 - DNA, 15 bp, Homo sapiens
tcttttgtgtaaagc

SEQ ID NO: 9279 - DNA, 15 bp, Homo sapiens
cttttgtgtaaagcg

SEQ ID NO: 9280 - DNA, 15 bp, Homo sapiens
ttttgtgtaaagcgg

SEQ ID NO: 9281 - DNA, 15 bp, Homo sapiens
tttgtgtaaagcggt

SEQ ID NO: 9282 - DNA, 15 bp, Homo sapiens
ttgtgtaaagcggtg

SEQ ID NO: 9283 - DNA, 15 bp, Homo sapiens
tgtgtaaagcggtga

SEQ ID NO: 9284 - DNA, 15 bp, Homo sapiens
gtgtaaagcggtgat

SEQ ID NO: 9285 - DNA, 15 bp, Homo sapiens
tgtaaagcggtgatt

SEQ ID NO: 9286 - DNA, 15 bp, Homo sapiens
gtaaagcggtgattt

SEQ ID NO: 9287 - DNA, 15 bp, Homo sapiens
taaagcggtgatttc

SEQ ID NO: 9288 - DNA, 15 bp, Homo sapiens
aaagcggtgatttct

SEQ ID NO: 9289 - DNA, 15 bp, Homo sapiens
aagcggtgatttctt

SEQ ID NO: 9290 - DNA, 15 bp, Homo sapiens
agcggtgatttcttc

SEQ ID NO: 9291 - DNA, 15 bp, Homo sapiens
gcggtgatttcttcc

SEQ ID NO: 9292 - DNA, 15 bp, Homo sapiens
cggtgatttcttcca

SEQ ID NO: 9293 - DNA, 15 bp, Homo sapiens
ggtgatttcttccat

SEQ ID NO: 9294 - DNA, 15 bp, Homo sapiens
gtgatttcttccatg

SEQ ID NO: 9295 - DNA, 15 bp, Homo sapiens
tgatttcttccatgg

SEQ ID NO: 9296 - DNA, 15 bp, Homo sapiens
gatttcttccatgga

SEQ ID NO: 9297 - DNA, 15 bp, Homo sapiens
atttcttccatggag

SEQ ID NO: 9298 - DNA, 15 bp, Homo sapiens
tttcttccatggagg

SEQ ID NO: 9299 - DNA, 15 bp, Homo sapiens
ttcttccatggaggg

SEQ ID NO: 9300 - DNA, 15 bp, Homo sapiens
tcttccatggaggga

SEQ ID NO: 9301 - DNA, 15 bp, Homo sapiens
cttccatggagggaa

SEQ ID NO: 9302 - DNA, 15 bp, Homo sapiens
ttccatggagggaat

SEQ ID NO: 9303 - DNA, 15 bp, Homo sapiens
tccatggagggaatg

SEQ ID NO: 9304 - DNA, 15 bp, Homo sapiens
ccatggagggaatgg

SEQ ID NO: 9305 - DNA, 15 bp, Homo sapiens
catggagggaatggt

SEQ ID NO: 9306 - DNA, 15 bp, Homo sapiens
atggagggaatggta

SEQ ID NO: 9307 - DNA, 15 bp, Homo sapiens
tggagggaatggtat

SEQ ID NO: 9308 - DNA, 15 bp, Homo sapiens
ggagggaatggtatt

SEQ ID NO: 9309 - DNA, 15 bp, Homo sapiens
gagggaatggtattt

SEQ ID NO: 9310 - DNA, 15 bp, Homo sapiens
agggaatggtattta

SEQ ID NO: 9311 - DNA, 15 bp, Homo sapiens
gggaatggtatttag

SEQ ID NO: 9312 - DNA, 15 bp, Homo sapiens
ggaatggtatttagg

SEQ ID NO: 9313 - DNA, 15 bp, Homo sapiens
gaatggtatttaggc

SEQ ID NO: 9314 - DNA, 15 bp, Homo sapiens
aatggtatttaggca

SEQ ID NO: 9315 - DNA, 15 bp, Homo sapiens
atggtatttaggcaa

SEQ ID NO: 9316 - DNA, 15 bp, Homo sapiens
tggtatttaggcaat

SEQ ID NO: 9317 - DNA, 15 bp, Homo sapiens
ggtatttaggcaatt

SEQ ID NO: 9318 - DNA, 15 bp, Homo sapiens
gtatttaggcaattt

SEQ ID NO: 9319 - DNA, 15 bp, Homo sapiens
tatttaggcaatttt

SEQ ID NO: 9320 - DNA, 15 bp, Homo sapiens
atttaggcaattttt

SEQ ID NO: 9321 - DNA, 15 bp, Homo sapiens
tttaggcaatttttt

SEQ ID NO: 9322 - DNA, 15 bp, Homo sapiens
ttaggcaattttttt

SEQ ID NO: 9323 - DNA, 15 bp, Homo sapiens
taggcaatttttttt

SEQ ID NO: 9324 - DNA, 15 bp, Homo sapiens
aggcaattttttttt

SEQ ID NO: 9325 - DNA, 15 bp, Homo sapiens
ggcaatttttttttt

SEQ ID NO: 9326 - DNA, 15 bp, Homo sapiens
gcaattttttttttt

SEQ ID NO: 9327 - DNA, 15 bp, Homo sapiens
caatttttttttttt

SEQ ID NO: 9328 - DNA, 15 bp, Homo sapiens
tttttttttttttcg

SEQ ID NO: 9329 - DNA, 15 bp, Homo sapiens
ttttttttttttcga

SEQ ID NO: 9330 - DNA, 15 bp, Homo sapiens
tttttttttttcgag

SEQ ID NO: 9331 - DNA, 15 bp, Homo sapiens
ttttttttttcgaga

SEQ ID NO: 9332 - DNA, 15 bp, Homo sapiens
tttttttttcgagat

SEQ ID NO: 9333 - DNA, 15 bp, Homo sapiens
ttttttttcgagatg

SEQ ID NO: 9334 - DNA, 15 bp, Homo sapiens
tttttttcgagatgg

SEQ ID NO: 9335 - DNA, 15 bp, Homo sapiens
ttttttcgagatgga

SEQ ID NO: 9336 - DNA, 15 bp, Homo sapiens
tttttcgagatggag

SEQ ID NO: 9337 - DNA, 15 bp, Homo sapiens
ttttcgagatggagt

SEQ ID NO: 9338 - DNA, 15 bp, Homo sapiens
tttcgagatggagtc

SEQ ID NO: 9339 - DNA, 15 bp, Homo sapiens
ttcgagatggagtct

SEQ ID NO: 9340 - DNA, 15 bp, Homo sapiens
tcgagatggagtctt

SEQ ID NO: 9341 - DNA, 15 bp, Homo sapiens
cgagatggagtcttg

SEQ ID NO: 9342 - DNA, 15 bp, Homo sapiens
tcttgctctgtcgct

SEQ ID NO: 9343 - DNA, 15 bp, Homo sapiens
cttgctctgtcgctc

SEQ ID NO: 9344 - DNA, 15 bp, Homo sapiens
ttgctctgtcgctca

SEQ ID NO: 9345 - DNA, 15 bp, Homo sapiens
tgctctgtcgctcag

SEQ ID NO: 9346 - DNA, 15 bp, Homo sapiens
gctctgtcgctcagg

SEQ ID NO: 9347 - DNA, 15 bp, Homo sapiens
ctctgtcgctcaggc

SEQ ID NO: 9348 - DNA, 15 bp, Homo sapiens
tctgtcgctcaggct

SEQ ID NO: 9349 - DNA, 15 bp, Homo sapiens
ctgtcgctcaggctg

SEQ ID NO: 9350 - DNA, 15 bp, Homo sapiens
tgtcgctcaggctgg

SEQ ID NO: 9351 - DNA, 15 bp, Homo sapiens
gtcgctcaggctgga

SEQ ID NO: 9352 - DNA, 15 bp, Homo sapiens
tcgctcaggctggag

SEQ ID NO: 9353 - DNA, 15 bp, Homo sapiens
cgctcaggctggagt

SEQ ID NO: 9354 - DNA, 15 bp, Homo sapiens
gctcaggctggagtg

SEQ ID NO: 9355 - DNA, 15 bp, Homo sapiens
tgcagtggcaccatt

SEQ ID NO: 9356 - DNA, 15 bp, Homo sapiens
gcagtggcaccattt

SEQ ID NO: 9357 - DNA, 15 bp, Homo sapiens
cagtggcaccatttc

SEQ ID NO: 9358 - DNA, 15 bp, Homo sapiens
agtggcaccatttca

SEQ ID NO: 9359 - DNA, 15 bp, Homo sapiens
gtggcaccatttcag

SEQ ID NO: 9360 - DNA, 15 bp, Homo sapiens
tggcaccatttcagc

SEQ ID NO: 9361 - DNA, 15 bp, Homo sapiens
ggcaccatttcagct

SEQ ID NO: 9362 - DNA, 15 bp, Homo sapiens
gcaccatttcagctc

SEQ ID NO: 9363 - DNA, 15 bp, Homo sapiens
caccatttcagctca

SEQ ID NO: 9364 - DNA, 15 bp, Homo sapiens
accatttcagctcac

SEQ ID NO: 9365 - DNA, 15 bp, Homo sapiens
ccatttcagctcact

SEQ ID NO: 9366 - DNA, 15 bp, Homo sapiens
catttcagctcactg

SEQ ID NO: 9367 - DNA, 15 bp, Homo sapiens
atttcagctcactgc

SEQ ID NO: 9368 - DNA, 15 bp, Homo sapiens
tttcagctcactgca

SEQ ID NO: 9369 - DNA, 15 bp, Homo sapiens
ttcagctcactgcaa

SEQ ID NO: 9370 - DNA, 15 bp, Homo sapiens
cagctcactgcaact

SEQ ID NO: 9371 - DNA, 15 bp, Homo sapiens
agctcactgcaactt

SEQ ID NO: 9372 - DNA, 15 bp, Homo sapiens
gctcactgcaacttc

SEQ ID NO: 9373 - DNA, 15 bp, Homo sapiens
ctcactgcaacttcc

SEQ ID NO: 9374 - DNA, 15 bp, Homo sapiens
tcactgcaacttcca

SEQ ID NO: 9375 - DNA, 15 bp, Homo sapiens
cactgcaacttccac

SEQ ID NO: 9376 - DNA, 15 bp, Homo sapiens
actgcaacttccacc

SEQ ID NO: 9377 - DNA, 15 bp, Homo sapiens
ctgcaacttccacct

SEQ ID NO: 9378 - DNA, 15 bp, Homo sapiens
tgcaacttccacctc

SEQ ID NO: 9379 - DNA, 15 bp, Homo sapiens
gcaacttccacctcc

SEQ ID NO: 9380 - DNA, 15 bp, Homo sapiens
caacttccacctcct

SEQ ID NO: 9381 - DNA, 15 bp, Homo sapiens
aacttccacctcctg

SEQ ID NO: 9382 - DNA, 15 bp, Homo sapiens
acttccacctcctgg

SEQ ID NO: 9383 - DNA, 15 bp, Homo sapiens
cttccacctcctggg

SEQ ID NO: 9384 - DNA, 15 bp, Homo sapiens
ttccacctcctgggt

SEQ ID NO: 9385 - DNA, 15 bp, Homo sapiens
tccacctcctgggtt

SEQ ID NO: 9386 - DNA, 15 bp, Homo sapiens
ccacctcctgggttc

SEQ ID NO: 9387 - DNA, 15 bp, Homo sapiens
cacctcctgggttca

SEQ ID NO: 9388 - DNA, 15 bp, Homo sapiens
acctcctgggttcaa

SEQ ID NO: 9389 - DNA, 15 bp, Homo sapiens
ctcctgggttcaagt

SEQ ID NO: 9390 - DNA, 15 bp, Homo sapiens
tcctgggttcaagtg

SEQ ID NO: 9391 - DNA, 15 bp, Homo sapiens
cctgggttcaagtga

SEQ ID NO: 9392 - DNA, 15 bp, Homo sapiens
ctgggttcaagtgat

SEQ ID NO: 9393 - DNA, 15 bp, Homo sapiens
tgggttcaagtgatt

SEQ ID NO: 9394 - DNA, 15 bp, Homo sapiens
agtgattctcctgct

SEQ ID NO: 9395 - DNA, 15 bp, Homo sapiens
gtgattctcctgctt

SEQ ID NO: 9396 - DNA, 15 bp, Homo sapiens
tgattctcctgcttc

SEQ ID NO: 9397 - DNA, 15 bp, Homo sapiens
gattctcctgcttca

SEQ ID NO: 9398 - DNA, 15 bp, Homo sapiens
attctcctgcttcag

SEQ ID NO: 9399 - DNA, 15 bp, Homo sapiens
ttctcctgcttcagc

SEQ ID NO: 9400 - DNA, 15 bp, Homo sapiens
tctcctgcttcagcc

SEQ ID NO: 9401 - DNA, 15 bp, Homo sapiens
ctcctgcttcagcct

SEQ ID NO: 9402 - DNA, 15 bp, Homo sapiens
tcctgcttcagcctc

SEQ ID NO: 9403 - DNA, 15 bp, Homo sapiens
cctgcttcagcctcc

SEQ ID NO: 9404 - DNA, 15 bp, Homo sapiens
ctgcttcagcctccc

SEQ ID NO: 9405 - DNA, 15 bp, Homo sapiens
tgcttcagcctccca

SEQ ID NO: 9406 - DNA, 15 bp, Homo sapiens
gcttcagcctcccaa

SEQ ID NO: 9407 - DNA, 15 bp, Homo sapiens
cttcagcctcccaag

SEQ ID NO: 9408 - DNA, 15 bp, Homo sapiens
ttcagcctcccaagt

SEQ ID NO: 9409 - DNA, 15 bp, Homo sapiens
ctcccaagtagctga

SEQ ID NO: 9410 - DNA, 15 bp, Homo sapiens
tcccaagtagctgag

SEQ ID NO: 9411 - DNA, 15 bp, Homo sapiens
cccaagtagctgaga

SEQ ID NO: 9412 - DNA, 15 bp, Homo sapiens
ccaagtagctgagat

SEQ ID NO: 9413 - DNA, 15 bp, Homo sapiens
caagtagctgagatt

SEQ ID NO: 9414 - DNA, 15 bp, Homo sapiens
aagtagctgagatta

SEQ ID NO: 9415 - DNA, 15 bp, Homo sapiens
tgagattacaggcac

SEQ ID NO: 9416 - DNA, 15 bp, Homo sapiens
gagattacaggcacc

SEQ ID NO: 9417 - DNA, 15 bp, Homo sapiens
agattacaggcaccc

SEQ ID NO: 9418 - DNA, 15 bp, Homo sapiens
gattacaggcacccg

SEQ ID NO: 9419 - DNA, 15 bp, Homo sapiens
attacaggcacccgc

SEQ ID NO: 9420 - DNA, 15 bp, Homo sapiens
ttacaggcacccgcc

SEQ ID NO: 9421 - DNA, 15 bp, Homo sapiens
tacaggcacccgcca

SEQ ID NO: 9422 - DNA, 15 bp, Homo sapiens
acaggcacccgccac

SEQ ID NO: 9423 - DNA, 15 bp, Homo sapiens
caggcacccgccacc

SEQ ID NO: 9424 - DNA, 15 bp, Homo sapiens
aggcacccgccacca

SEQ ID NO: 9425 - DNA, 15 bp, Homo sapiens
ggcacccgccaccac

SEQ ID NO: 9426 - DNA, 15 bp, Homo sapiens
gcacccgccaccaca

SEQ ID NO: 9427 - DNA, 15 bp, Homo sapiens
cacccgccaccacac

SEQ ID NO: 9428 - DNA, 15 bp, Homo sapiens
acccgccaccacacc

SEQ ID NO: 9429 - DNA, 15 bp, Homo sapiens
cccgccaccacaccc

SEQ ID NO: 9430 - DNA, 15 bp, Homo sapiens
ccgccaccacacccg

SEQ ID NO: 9431 - DNA, 15 bp, Homo sapiens
cgccaccacacccgg

SEQ ID NO: 9432 - DNA, 15 bp, Homo sapiens
gccaccacacccggc

SEQ ID NO: 9433 - DNA, 15 bp, Homo sapiens
caccacacccggctt

SEQ ID NO: 9434 - DNA, 15 bp, Homo sapiens
accacacccggctta

SEQ ID NO: 9435 - DNA, 15 bp, Homo sapiens
ccacacccggcttat

SEQ ID NO: 9436 - DNA, 15 bp, Homo sapiens
cacacccggcttatt

SEQ ID NO: 9437 - DNA, 15 bp, Homo sapiens
acacccggcttattt

SEQ ID NO: 9438 - DNA, 15 bp, Homo sapiens
cacccggcttatttt

SEQ ID NO: 9439 - DNA, 15 bp, Homo sapiens
acccggcttattttg

SEQ ID NO: 9440 - DNA, 15 bp, Homo sapiens
cccggcttattttgt

SEQ ID NO: 9441 - DNA, 15 bp, Homo sapiens
ccggcttattttgta

SEQ ID NO: 9442 - DNA, 15 bp, Homo sapiens
cggcttattttgtat

SEQ ID NO: 9443 - DNA, 15 bp, Homo sapiens
ggcttattttgtatt

SEQ ID NO: 9444 - DNA, 15 bp, Homo sapiens
gcttattttgtattt

SEQ ID NO: 9445 - DNA, 15 bp, Homo sapiens
cttattttgtatttt

SEQ ID NO: 9446 - DNA, 15 bp, Homo sapiens
ttattttgtattttt

SEQ ID NO: 9447 - DNA, 15 bp, Homo sapiens
tattttgtattttta

SEQ ID NO: 9448 - DNA, 15 bp, Homo sapiens
gacctcaagtgatct

SEQ ID NO: 9449 - DNA, 15 bp, Homo sapiens
acctcaagtgatctc

SEQ ID NO: 9450 - DNA, 15 bp, Homo sapiens
cctcaagtgatctcc

SEQ ID NO: 9451 - DNA, 15 bp, Homo sapiens
ctcaagtgatctccc

SEQ ID NO: 9452 - DNA, 15 bp, Homo sapiens
tcaagtgatctcccc

SEQ ID NO: 9453 - DNA, 15 bp, Homo sapiens
caagtgatctcccca

SEQ ID NO: 9454 - DNA, 15 bp, Homo sapiens
aagtgatctccccac

SEQ ID NO: 9455 - DNA, 15 bp, Homo sapiens
agtgatctccccacc

SEQ ID NO: 9456 - DNA, 15 bp, Homo sapiens
gtgatctccccacct

SEQ ID NO: 9457 - DNA, 15 bp, Homo sapiens
tgatctccccacctt

SEQ ID NO: 9458 - DNA, 15 bp, Homo sapiens
gatctccccaccttg

SEQ ID NO: 9459 - DNA, 15 bp, Homo sapiens
atctccccaccttgg

SEQ ID NO: 9460 - DNA, 15 bp, Homo sapiens
tctccccaccttggc

SEQ ID NO: 9461 - DNA, 15 bp, Homo sapiens
ctccccaccttggcc

SEQ ID NO: 9462 - DNA, 15 bp, Homo sapiens
tccccaccttggcct

SEQ ID NO: 9463 - DNA, 15 bp, Homo sapiens
ccccaccttggcctt

SEQ ID NO: 9464 - DNA, 15 bp, Homo sapiens
cccaccttggccttc

SEQ ID NO: 9465 - DNA, 15 bp, Homo sapiens
ccaccttggccttcc

SEQ ID NO: 9466 - DNA, 15 bp, Homo sapiens
caccttggccttcca

SEQ ID NO: 9467 - DNA, 15 bp, Homo sapiens
accttggccttccaa

SEQ ID NO: 9468 - DNA, 15 bp, Homo sapiens
ccttggccttccaaa

SEQ ID NO: 9469 - DNA, 15 bp, Homo sapiens
cttggccttccaaag

SEQ ID NO: 9470 - DNA, 15 bp, Homo sapiens
ttggccttccaaagt

SEQ ID NO: 9471 - DNA, 15 bp, Homo sapiens
tggccttccaaagtg

SEQ ID NO: 9472 - DNA, 15 bp, Homo sapiens
ggccttccaaagtgc

SEQ ID NO: 9473 - DNA, 15 bp, Homo sapiens
gccttccaaagtgct

SEQ ID NO: 9474 - DNA, 15 bp, Homo sapiens
ccttccaaagtgcta

SEQ ID NO: 9475 - DNA, 15 bp, Homo sapiens
cttccaaagtgctag

SEQ ID NO: 9476 - DNA, 15 bp, Homo sapiens
ttccaaagtgctagg

SEQ ID NO: 9477 - DNA, 15 bp, Homo sapiens
tccaaagtgctagga

SEQ ID NO: 9478 - DNA, 15 bp, Homo sapiens
ctaggattacaggcg

SEQ ID NO: 9479 - DNA, 15 bp, Homo sapiens
taggattacaggcgc

SEQ ID NO: 9480 - DNA, 15 bp, Homo sapiens
aggattacaggcgcc

SEQ ID NO: 9481 - DNA, 15 bp, Homo sapiens
gattacaggcgccta

SEQ ID NO: 9482 - DNA, 15 bp, Homo sapiens
attacaggcgcctag

SEQ ID NO: 9483 - DNA, 15 bp, Homo sapiens
ttacaggcgcctagc

SEQ ID NO: 9484 - DNA, 15 bp, Homo sapiens
tacaggcgcctagcc

SEQ ID NO: 9485 - DNA, 15 bp, Homo sapiens
acaggcgcctagcct

SEQ ID NO: 9486 - DNA, 15 bp, Homo sapiens
caggcgcctagccta

SEQ ID NO: 9487 - DNA, 15 bp, Homo sapiens
aggcgcctagcctag

SEQ ID NO: 9488 - DNA, 15 bp, Homo sapiens
ggcgcctagcctagg

SEQ ID NO: 9489 - DNA, 15 bp, Homo sapiens
gcgcctagcctaggc

SEQ ID NO: 9490 - DNA, 15 bp, Homo sapiens
cgcctagcctaggca

SEQ ID NO: 9491 - DNA, 15 bp, Homo sapiens
gcctagcctaggcag

SEQ ID NO: 9492 - DNA, 15 bp, Homo sapiens
cctagcctaggcagt

SEQ ID NO: 9493 - DNA, 15 bp, Homo sapiens
ctagcctaggcagtc

SEQ ID NO: 9494 - DNA, 15 bp, Homo sapiens
tagcctaggcagtca

SEQ ID NO: 9495 - DNA, 15 bp, Homo sapiens
agcctaggcagtcat

SEQ ID NO: 9496 - DNA, 15 bp, Homo sapiens
gcctaggcagtcatt

SEQ ID NO: 9497 - DNA, 15 bp, Homo sapiens
cctaggcagtcattt

SEQ ID NO: 9498 - DNA, 15 bp, Homo sapiens
ctaggcagtcatttt

SEQ ID NO: 9499 - DNA, 15 bp, Homo sapiens
taggcagtcattttc

SEQ ID NO: 9500 - DNA, 15 bp, Homo sapiens
aggcagtcattttca

SEQ ID NO: 9501 - DNA, 15 bp, Homo sapiens
ggcagtcattttcaa

SEQ ID NO: 9502 - DNA, 15 bp, Homo sapiens
gcagtcattttcaaa

SEQ ID NO: 9503 - DNA, 15 bp, Homo sapiens
cagtcattttcaaaa

SEQ ID NO: 9504 - DNA, 15 bp, Homo sapiens
agtcattttcaaaaa

SEQ ID NO: 9505 - DNA, 15 bp, Homo sapiens
gtcattttcaaaaaa

SEQ ID NO: 9506 - DNA, 15 bp, Homo sapiens
tcattttcaaaaaac

SEQ ID NO: 9507 - DNA, 15 bp, Homo sapiens
cattttcaaaaaaca

SEQ ID NO: 9508 - DNA, 15 bp, Homo sapiens
attttcaaaaaacaa

SEQ ID NO: 9509 - DNA, 15 bp, Homo sapiens
ttttcaaaaaacaag

SEQ ID NO: 9510 - DNA, 15 bp, Homo sapiens
tttcaaaaaacaagc

SEQ ID NO: 9511 - DNA, 15 bp, Homo sapiens
ttcaaaaaacaagca

SEQ ID NO: 9512 - DNA, 15 bp, Homo sapiens
tcaaaaaacaagcat

SEQ ID NO: 9513 - DNA, 15 bp, Homo sapiens
caaaaaacaagcatg

SEQ ID NO: 9514 - DNA, 15 bp, Homo sapiens
aaaaaacaagcatga

SEQ ID NO: 9515 - DNA, 15 bp, Homo sapiens
aaaaacaagcatgac

SEQ ID NO: 9516 - DNA, 15 bp, Homo sapiens
aaaacaagcatgact

SEQ ID NO: 9517 - DNA, 15 bp, Homo sapiens
aaacaagcatgactc

SEQ ID NO: 9518 - DNA, 15 bp, Homo sapiens
aacaagcatgactca

SEQ ID NO: 9519 - DNA, 15 bp, Homo sapiens
acaagcatgactcac

SEQ ID NO: 9520 - DNA, 15 bp, Homo sapiens
caagcatgactcacc

SEQ ID NO: 9521 - DNA, 15 bp, Homo sapiens
aagcatgactcacca

SEQ ID NO: 9522 - DNA, 15 bp, Homo sapiens
agcatgactcaccaa

SEQ ID NO: 9523 - DNA, 15 bp, Homo sapiens
gcatgactcaccaaa

SEQ ID NO: 9524 - DNA, 15 bp, Homo sapiens
catgactcaccaaaa

SEQ ID NO: 9525 - DNA, 15 bp, Homo sapiens
atgactcaccaaaag

SEQ ID NO: 9526 - DNA, 15 bp, Homo sapiens
tgactcaccaaaagt

SEQ ID NO: 9527 - DNA, 15 bp, Homo sapiens
gactcaccaaaagtt

SEQ ID NO: 9528 - DNA, 15 bp, Homo sapiens
actcaccaaaagttt

SEQ ID NO: 9529 - DNA, 15 bp, Homo sapiens
ctcaccaaaagtttt

SEQ ID NO: 9530 - DNA, 15 bp, Homo sapiens
tcaccaaaagtttta

SEQ ID NO: 9531 - DNA, 15 bp, Homo sapiens
caccaaaagttttaa

SEQ ID NO: 9532 - DNA, 15 bp, Homo sapiens
accaaaagttttaag

SEQ ID NO: 9533 - DNA, 15 bp, Homo sapiens
ccaaaagttttaaga

SEQ ID NO: 9534 - DNA, 15 bp, Homo sapiens
caaaagttttaagat

SEQ ID NO: 9535 - DNA, 15 bp, Homo sapiens
aaaagttttaagatt

SEQ ID NO: 9536 - DNA, 15 bp, Homo sapiens
aaagttttaagattt

SEQ ID NO: 9537 - DNA, 15 bp, Homo sapiens
aagttttaagatttt

SEQ ID NO: 9538 - DNA, 15 bp, Homo sapiens
agttttaagattttc

SEQ ID NO: 9539 - DNA, 15 bp, Homo sapiens
gttttaagattttct

SEQ ID NO: 9540 - DNA, 15 bp, Homo sapiens
ttttaagattttctg

SEQ ID NO: 9541 - DNA, 15 bp, Homo sapiens
tttaagattttctgt

SEQ ID NO: 9542 - DNA, 15 bp, Homo sapiens
ttaagattttctgtg

SEQ ID NO: 9543 - DNA, 15 bp, Homo sapiens
taagattttctgtga

SEQ ID NO: 9544 - DNA, 15 bp, Homo sapiens
aagattttctgtgat

SEQ ID NO: 9545 - DNA, 15 bp, Homo sapiens
agattttctgtgata

SEQ ID NO: 9546 - DNA, 15 bp, Homo sapiens
gattttctgtgataa

SEQ ID NO: 9547 - DNA, 15 bp, Homo sapiens
attttctgtgataat

SEQ ID NO: 9548 - DNA, 15 bp, Homo sapiens
ttttctgtgataatg

SEQ ID NO: 9549 - DNA, 15 bp, Homo sapiens
tttctgtgataatgt

SEQ ID NO: 9550 - DNA, 15 bp, Homo sapiens
ttctgtgataatgtt

SEQ ID NO: 9551 - DNA, 15 bp, Homo sapiens
tctgtgataatgttc

SEQ ID NO: 9552 - DNA, 15 bp, Homo sapiens
ctgtgataatgttct

SEQ ID NO: 9553 - DNA, 15 bp, Homo sapiens
tgtgataatgttctt

SEQ ID NO: 9554 - DNA, 15 bp, Homo sapiens
gtgataatgttctta

SEQ ID NO: 9555 - DNA, 15 bp, Homo sapiens
tgataatgttcttat

SEQ ID NO: 9556 - DNA, 15 bp, Homo sapiens
gataatgttcttatt

SEQ ID NO: 9557 - DNA, 15 bp, Homo sapiens
ataatgttcttattg

SEQ ID NO: 9558 - DNA, 15 bp, Homo sapiens
taatgttcttattga

SEQ ID NO: 9559 - DNA, 15 bp, Homo sapiens
aatgttcttattgag

SEQ ID NO: 9560 - DNA, 15 bp, Homo sapiens
atgttcttattgagg

SEQ ID NO: 9561 - DNA, 15 bp, Homo sapiens
tgttcttattgaggc

SEQ ID NO: 9562 - DNA, 15 bp, Homo sapiens
gttcttattgaggct

SEQ ID NO: 9563 - DNA, 15 bp, Homo sapiens
ttcttattgaggctt

SEQ ID NO: 9564 - DNA, 15 bp, Homo sapiens
tcttattgaggctta

SEQ ID NO: 9565 - DNA, 15 bp, Homo sapiens
cttattgaggcttac

SEQ ID NO: 9566 - DNA, 15 bp, Homo sapiens
ttattgaggcttaca

SEQ ID NO: 9567 - DNA, 15 bp, Homo sapiens
tattgaggcttacat

SEQ ID NO: 9568 - DNA, 15 bp, Homo sapiens
attgaggcttacatt

SEQ ID NO: 9569 - DNA, 15 bp, Homo sapiens
ttgaggcttacatta

SEQ ID NO: 9570 - DNA, 15 bp, Homo sapiens
tgaggcttacattat

SEQ ID NO: 9571 - DNA, 15 bp, Homo sapiens
gaggcttacattata

SEQ ID NO: 9572 - DNA, 15 bp, Homo sapiens
aggcttacattatat

SEQ ID NO: 9573 - DNA, 15 bp, Homo sapiens
ggcttacattatatt

SEQ ID NO: 9574 - DNA, 15 bp, Homo sapiens
gcttacattatatta

SEQ ID NO: 9575 - DNA, 15 bp, Homo sapiens
cttacattatattac

SEQ ID NO: 9576 - DNA, 15 bp, Homo sapiens
ttacattatattaca

SEQ ID NO: 9577 - DNA, 15 bp, Homo sapiens
tacattatattacag

SEQ ID NO: 9578 - DNA, 15 bp, Homo sapiens
acattatattacagt

SEQ ID NO: 9579 - DNA, 15 bp, Homo sapiens
cattatattacagtt

SEQ ID NO: 9580 - DNA, 15 bp, Homo sapiens
attatattacagttt

SEQ ID NO: 9581 - DNA, 15 bp, Homo sapiens
ttatattacagtttc

SEQ ID NO: 9582 - DNA, 15 bp, Homo sapiens
tatattacagtttct

SEQ ID NO: 9583 - DNA, 15 bp, Homo sapiens
atattacagtttctt

SEQ ID NO: 9584 - DNA, 15 bp, Homo sapiens
tattacagtttcttg

SEQ ID NO: 9585 - DNA, 15 bp, Homo sapiens
attacagtttcttga

SEQ ID NO: 9586 - DNA, 15 bp, Homo sapiens
ttacagtttcttgaa

SEQ ID NO: 9587 - DNA, 15 bp, Homo sapiens
tacagtttcttgaat

SEQ ID NO: 9588 - DNA, 15 bp, Homo sapiens
acagtttcttgaatc

SEQ ID NO: 9589 - DNA, 15 bp, Homo sapiens
cagtttcttgaatct

SEQ ID NO: 9590 - DNA, 15 bp, Homo sapiens
agtttcttgaatcta

SEQ ID NO: 9591 - DNA, 15 bp, Homo sapiens
gtttcttgaatctaa

SEQ ID NO: 9592 - DNA, 15 bp, Homo sapiens
tttcttgaatctaaa

SEQ ID NO: 9593 - DNA, 15 bp, Homo sapiens
ttcttgaatctaaaa

SEQ ID NO: 9594 - DNA, 15 bp, Homo sapiens
tcttgaatctaaaat

SEQ ID NO: 9595 - DNA, 15 bp, Homo sapiens
cttgaatctaaaatg

SEQ ID NO: 9596 - DNA, 15 bp, Homo sapiens
ttgaatctaaaatga

SEQ ID NO: 9597 - DNA, 15 bp, Homo sapiens
tgaatctaaaatgat

SEQ ID NO: 9598 - DNA, 15 bp, Homo sapiens
gaatctaaaatgatg

SEQ ID NO: 9599 - DNA, 15 bp, Homo sapiens
aatctaaaatgatgt

SEQ ID NO: 9600 - DNA, 15 bp, Homo sapiens
atctaaaatgatgta

SEQ ID NO: 9601 - DNA, 15 bp, Homo sapiens
tctaaaatgatgtac

SEQ ID NO: 9602 - DNA, 15 bp, Homo sapiens
ctaaaatgatgtacc

SEQ ID NO: 9603 - DNA, 15 bp, Homo sapiens
taaaatgatgtaccc

SEQ ID NO: 9604 - DNA, 15 bp, Homo sapiens
aaaatgatgtaccct

SEQ ID NO: 9605 - DNA, 15 bp, Homo sapiens
aaatgatgtaccctc

SEQ ID NO: 9606 - DNA, 15 bp, Homo sapiens
aatgatgtaccctct

SEQ ID NO: 9607 - DNA, 15 bp, Homo sapiens
atgatgtaccctctt

SEQ ID NO: 9608 - DNA, 15 bp, Homo sapiens
tgatgtaccctctta

SEQ ID NO: 9609 - DNA, 15 bp, Homo sapiens
gatgtaccctcttag

SEQ ID NO: 9610 - DNA, 15 bp, Homo sapiens
atgtaccctcttagg

SEQ ID NO: 9611 - DNA, 15 bp, Homo sapiens
tgtaccctcttagga

SEQ ID NO: 9612 - DNA, 15 bp, Homo sapiens
gtaccctcttaggat

SEQ ID NO: 9613 - DNA, 15 bp, Homo sapiens
taccctcttaggata

SEQ ID NO: 9614 - DNA, 15 bp, Homo sapiens
accctcttaggatat

SEQ ID NO: 9615 - DNA, 15 bp, Homo sapiens
ccctcttaggatata

SEQ ID NO: 9616 - DNA, 15 bp, Homo sapiens
cctcttaggatatat

SEQ ID NO: 9617 - DNA, 15 bp, Homo sapiens
ctcttaggatatata

SEQ ID NO: 9618 - DNA, 15 bp, Homo sapiens
tcttaggatatatac

SEQ ID NO: 9619 - DNA, 15 bp, Homo sapiens
cttaggatatataca

SEQ ID NO: 9620 - DNA, 15 bp, Homo sapiens
ttaggatatatacat

SEQ ID NO: 9621 - DNA, 15 bp, Homo sapiens
taggatatatacatc

SEQ ID NO: 9622 - DNA, 15 bp, Homo sapiens
aggatatatacatca

SEQ ID NO: 9623 - DNA, 15 bp, Homo sapiens
ggatatatacatcat

SEQ ID NO: 9624 - DNA, 15 bp, Homo sapiens
gatatatacatcatg

SEQ ID NO: 9625 - DNA, 15 bp, Homo sapiens
atatatacatcatgc

SEQ ID NO: 9626 - DNA, 15 bp, Homo sapiens
tatatacatcatgct

SEQ ID NO: 9627 - DNA, 15 bp, Homo sapiens
atatacatcatgctt

SEQ ID NO: 9628 - DNA, 15 bp, Homo sapiens
tatacatcatgcttc

SEQ ID NO: 9629 - DNA, 15 bp, Homo sapiens
atacatcatgcttca

SEQ ID NO: 9630 - DNA, 15 bp, Homo sapiens
tacatcatgcttcat

SEQ ID NO: 9631 - DNA, 15 bp, Homo sapiens
acatcatgcttcatt

SEQ ID NO: 9632 - DNA, 15 bp, Homo sapiens
catcatgcttcattg

SEQ ID NO: 9633 - DNA, 15 bp, Homo sapiens
atcatgcttcattgg

SEQ ID NO: 9634 - DNA, 15 bp, Homo sapiens
tcatgcttcattggt

SEQ ID NO: 9635 - DNA, 15 bp, Homo sapiens
catgcttcattggtc

SEQ ID NO: 9636 - DNA, 15 bp, Homo sapiens
atgcttcattggtct

SEQ ID NO: 9637 - DNA, 15 bp, Homo sapiens
tgcttcattggtctc

SEQ ID NO: 9638 - DNA, 15 bp, Homo sapiens
gcttcattggtctca

SEQ ID NO: 9639 - DNA, 15 bp, Homo sapiens
cttcattggtctcag

SEQ ID NO: 9640 - DNA, 15 bp, Homo sapiens
ttcattggtctcagg

SEQ ID NO: 9641 - DNA, 15 bp, Homo sapiens
tcattggtctcaggg

SEQ ID NO: 9642 - DNA, 15 bp, Homo sapiens
cattggtctcagggg

SEQ ID NO: 9643 - DNA, 15 bp, Homo sapiens
attggtctcaggggg

SEQ ID NO: 9644 - DNA, 15 bp, Homo sapiens
ttggtctcagggggc

SEQ ID NO: 9645 - DNA, 15 bp, Homo sapiens
tggtctcagggggct

SEQ ID NO: 9646 - DNA, 15 bp, Homo sapiens
ggtctcagggggctg

SEQ ID NO: 9647 - DNA, 15 bp, Homo sapiens
gtctcagggggctga

SEQ ID NO: 9648 - DNA, 15 bp, Homo sapiens
tctcagggggctgat

SEQ ID NO: 9649 - DNA, 15 bp, Homo sapiens
ctcagggggctgatt

SEQ ID NO: 9650 - DNA, 15 bp, Homo sapiens
tcagggggctgattt

SEQ ID NO: 9651 - DNA, 15 bp, Homo sapiens
cagggggctgatttt

SEQ ID NO: 9652 - DNA, 15 bp, Homo sapiens
agggggctgattttt

SEQ ID NO: 9653 - DNA, 15 bp, Homo sapiens
gggggctgattttta

SEQ ID NO: 9654 - DNA, 15 bp, Homo sapiens
ggggctgatttttat

SEQ ID NO: 9655 - DNA, 15 bp, Homo sapiens
gggctgatttttata

SEQ ID NO: 9656 - DNA, 15 bp, Homo sapiens
ggctgatttttataa

SEQ ID NO: 9657 - DNA, 15 bp, Homo sapiens
gctgatttttataag

SEQ ID NO: 9658 - DNA, 15 bp, Homo sapiens
ctgatttttataagg

SEQ ID NO: 9659 - DNA, 15 bp, Homo sapiens
tgatttttataagga

SEQ ID NO: 9660 - DNA, 15 bp, Homo sapiens
gatttttataaggag

SEQ ID NO: 9661 - DNA, 15 bp, Homo sapiens
atttttataaggaga

SEQ ID NO: 9662 - DNA, 15 bp, Homo sapiens
tttttataaggagag

SEQ ID NO: 9663 - DNA, 15 bp, Homo sapiens
ttttataaggagaga

SEQ ID NO: 9664 - DNA, 15 bp, Homo sapiens
tttataaggagagat

SEQ ID NO: 9665 - DNA, 15 bp, Homo sapiens
ttataaggagagatt

SEQ ID NO: 9666 - DNA, 15 bp, Homo sapiens
tataaggagagattt

SEQ ID NO: 9667 - DNA, 15 bp, Homo sapiens
ataaggagagatttg

SEQ ID NO: 9668 - DNA, 15 bp, Homo sapiens
taaggagagatttgc

SEQ ID NO: 9669 - DNA, 15 bp, Homo sapiens
aaggagagatttgct

SEQ ID NO: 9670 - DNA, 15 bp, Homo sapiens
aggagagatttgcta

SEQ ID NO: 9671 - DNA, 15 bp, Homo sapiens
ggagagatttgctag

SEQ ID NO: 9672 - DNA, 15 bp, Homo sapiens
gagagatttgctagt

SEQ ID NO: 9673 - DNA, 15 bp, Homo sapiens
agagatttgctagtt

SEQ ID NO: 9674 - DNA, 15 bp, Homo sapiens
gagatttgctagttt

SEQ ID NO: 9675 - DNA, 15 bp, Homo sapiens
agatttgctagtttt

SEQ ID NO: 9676 - DNA, 15 bp, Homo sapiens
gatttgctagttttc

SEQ ID NO: 9677 - DNA, 15 bp, Homo sapiens
atttgctagttttca

SEQ ID NO: 9678 - DNA, 15 bp, Homo sapiens
tttgctagttttcac

SEQ ID NO: 9679 - DNA, 15 bp, Homo sapiens
ttgctagttttcaca

SEQ ID NO: 9680 - DNA, 15 bp, Homo sapiens
tgctagttttcacaa

SEQ ID NO: 9681 - DNA, 15 bp, Homo sapiens
gctagttttcacaat

SEQ ID NO: 9682 - DNA, 15 bp, Homo sapiens
ctagttttcacaata

SEQ ID NO: 9683 - DNA, 15 bp, Homo sapiens
tagttttcacaatat

SEQ ID NO: 9684 - DNA, 15 bp, Homo sapiens
agttttcacaatatg

SEQ ID NO: 9685 - DNA, 15 bp, Homo sapiens
gttttcacaatatgt

SEQ ID NO: 9686 - DNA, 15 bp, Homo sapiens
ttttcacaatatgtc

SEQ ID NO: 9687 - DNA, 15 bp, Homo sapiens
tttcacaatatgtcc

SEQ ID NO: 9688 - DNA, 15 bp, Homo sapiens
ttcacaatatgtcct

SEQ ID NO: 9689 - DNA, 15 bp, Homo sapiens
tcacaatatgtcctc

SEQ ID NO: 9690 - DNA, 15 bp, Homo sapiens
cacaatatgtcctct

SEQ ID NO: 9691 - DNA, 15 bp, Homo sapiens
acaatatgtcctcta

SEQ ID NO: 9692 - DNA, 15 bp, Homo sapiens
caatatgtcctctaa

SEQ ID NO: 9693 - DNA, 15 bp, Homo sapiens
aatatgtcctctaag

SEQ ID NO: 9694 - DNA, 15 bp, Homo sapiens
atatgtcctctaagt

SEQ ID NO: 9695 - DNA, 15 bp, Homo sapiens
tatgtcctctaagtt

SEQ ID NO: 9696 - DNA, 15 bp, Homo sapiens
atgtcctctaagttg

SEQ ID NO: 9697 - DNA, 15 bp, Homo sapiens
tgtcctctaagttgg

SEQ ID NO: 9698 - DNA, 15 bp, Homo sapiens
gtcctctaagttggc

SEQ ID NO: 9699 - DNA, 15 bp, Homo sapiens
tcctctaagttggca

SEQ ID NO: 9700 - DNA, 15 bp, Homo sapiens
cctctaagttggcat

SEQ ID NO: 9701 - DNA, 15 bp, Homo sapiens
ctctaagttggcatg

SEQ ID NO: 9702 - DNA, 15 bp, Homo sapiens
tctaagttggcatgt

SEQ ID NO: 9703 - DNA, 15 bp, Homo sapiens
ctaagttggcatgta

SEQ ID NO: 9704 - DNA, 15 bp, Homo sapiens
taagttggcatgtat

SEQ ID NO: 9705 - DNA, 15 bp, Homo sapiens
aagttggcatgtata

SEQ ID NO: 9706 - DNA, 15 bp, Homo sapiens
agttggcatgtatag

SEQ ID NO: 9707 - DNA, 15 bp, Homo sapiens
gttggcatgtatagc

SEQ ID NO: 9708 - DNA, 15 bp, Homo sapiens
ttggcatgtatagct

SEQ ID NO: 9709 - DNA, 15 bp, Homo sapiens
tggcatgtatagcta

SEQ ID NO: 9710 - DNA, 15 bp, Homo sapiens
ggcatgtatagctaa

SEQ ID NO: 9711 - DNA, 15 bp, Homo sapiens
gcatgtatagctaaa

SEQ ID NO: 9712 - DNA, 15 bp, Homo sapiens
catgtatagctaaac

SEQ ID NO: 9713 - DNA, 15 bp, Homo sapiens
atgtatagctaaaca

SEQ ID NO: 9714 - DNA, 15 bp, Homo sapiens
tgtatagctaaacag

SEQ ID NO: 9715 - DNA, 15 bp, Homo sapiens
gtatagctaaacagg

SEQ ID NO: 9716 - DNA, 15 bp, Homo sapiens
tatagctaaacaggc

SEQ ID NO: 9717 - DNA, 15 bp, Homo sapiens
atagctaaacaggct

SEQ ID NO: 9718 - DNA, 15 bp, Homo sapiens
tagctaaacaggctt

SEQ ID NO: 9719 - DNA, 15 bp, Homo sapiens
agctaaacaggcttt

SEQ ID NO: 9720 - DNA, 15 bp, Homo sapiens
gctaaacaggctttc

SEQ ID NO: 9721 - DNA, 15 bp, Homo sapiens
ctaaacaggctttca

SEQ ID NO: 9722 - DNA, 15 bp, Homo sapiens
taaacaggctttcat

SEQ ID NO: 9723 - DNA, 15 bp, Homo sapiens
aaacaggctttcata

SEQ ID NO: 9724 - DNA, 15 bp, Homo sapiens
aacaggctttcataa

SEQ ID NO: 9725 - DNA, 15 bp, Homo sapiens
acaggctttcataaa

SEQ ID NO: 9726 - DNA, 15 bp, Homo sapiens
caggctttcataaaa

SEQ ID NO: 9727 - DNA, 15 bp, Homo sapiens
aggctttcataaaaa

SEQ ID NO: 9728 - DNA, 15 bp, Homo sapiens
ggctttcataaaaat

SEQ ID NO: 9729 - DNA, 15 bp, Homo sapiens
gctttcataaaaata

SEQ ID NO: 9730 - DNA, 15 bp, Homo sapiens
ctttcataaaaatat

SEQ ID NO: 9731 - DNA, 15 bp, Homo sapiens
tttcataaaaatata

SEQ ID NO: 9732 - DNA, 15 bp, Homo sapiens
ttcataaaaatatac

SEQ ID NO: 9733 - DNA, 15 bp, Homo sapiens
tcataaaaatataca

SEQ ID NO: 9734 - DNA, 15 bp, Homo sapiens
cataaaaatatacaa

SEQ ID NO: 9735 - DNA, 15 bp, Homo sapiens
ataaaaatatacaat

SEQ ID NO: 9736 - DNA, 15 bp, Homo sapiens
taaaaatatacaatt

SEQ ID NO: 9737 - DNA, 15 bp, Homo sapiens
aaaaatatacaattt

SEQ ID NO: 9738 - DNA, 15 bp, Homo sapiens
aaaatatacaattta

SEQ ID NO: 9739 - DNA, 15 bp, Homo sapiens
aaatatacaatttag

SEQ ID NO: 9740 - DNA, 15 bp, Homo sapiens
aatatacaatttagt

SEQ ID NO: 9741 - DNA, 15 bp, Homo sapiens
atatacaatttagtt

SEQ ID NO: 9742 - DNA, 15 bp, Homo sapiens
tatacaatttagtta

SEQ ID NO: 9743 - DNA, 15 bp, Homo sapiens
atacaatttagttaa

SEQ ID NO: 9744 - DNA, 15 bp, Homo sapiens
tacaatttagttaat

SEQ ID NO: 9745 - DNA, 15 bp, Homo sapiens
acaatttagttaatg

SEQ ID NO: 9746 - DNA, 15 bp, Homo sapiens
caatttagttaatga

SEQ ID NO: 9747 - DNA, 15 bp, Homo sapiens
aatttagttaatgaa

SEQ ID NO: 9748 - DNA, 15 bp, Homo sapiens
atttagttaatgaaa

SEQ ID NO: 9749 - DNA, 15 bp, Homo sapiens
tttagttaatgaaat

SEQ ID NO: 9750 - DNA, 15 bp, Homo sapiens
ttagttaatgaaatt

SEQ ID NO: 9751 - DNA, 15 bp, Homo sapiens
tagttaatgaaattt

SEQ ID NO: 9752 - DNA, 15 bp, Homo sapiens
agttaatgaaatttg

SEQ ID NO: 9753 - DNA, 15 bp, Homo sapiens
gttaatgaaatttgg

SEQ ID NO: 9754 - DNA, 15 bp, Homo sapiens
ttaatgaaatttggg

SEQ ID NO: 9755 - DNA, 15 bp, Homo sapiens
taatgaaatttggga

SEQ ID NO: 9756 - DNA, 15 bp, Homo sapiens
aatgaaatttgggat

SEQ ID NO: 9757 - DNA, 15 bp, Homo sapiens
atgaaatttgggata

SEQ ID NO: 9758 - DNA, 15 bp, Homo sapiens
tgaaatttgggatat

SEQ ID NO: 9759 - DNA, 15 bp, Homo sapiens
gaaatttgggatata

SEQ ID NO: 9760 - DNA, 15 bp, Homo sapiens
aaatttgggatatag

SEQ ID NO: 9761 - DNA, 15 bp, Homo sapiens
aatttgggatatagt

SEQ ID NO: 9762 - DNA, 15 bp, Homo sapiens
atttgggatatagtc

SEQ ID NO: 9763 - DNA, 15 bp, Homo sapiens
tttgggatatagtct

SEQ ID NO: 9764 - DNA, 15 bp, Homo sapiens
ttgggatatagtctt

SEQ ID NO: 9765 - DNA, 15 bp, Homo sapiens
tgggatatagtcttt

SEQ ID NO: 9766 - DNA, 15 bp, Homo sapiens
gggatatagtctttt

SEQ ID NO: 9767 - DNA, 15 bp, Homo sapiens
ggatatagtctttta

SEQ ID NO: 9768 - DNA, 15 bp, Homo sapiens
gatatagtcttttat

SEQ ID NO: 9769 - DNA, 15 bp, Homo sapiens
atatagtcttttatg

SEQ ID NO: 9770 - DNA, 15 bp, Homo sapiens
tatagtcttttatga

SEQ ID NO: 9771 - DNA, 15 bp, Homo sapiens
atagtcttttatgat

SEQ ID NO: 9772 - DNA, 15 bp, Homo sapiens
tagtcttttatgatt

SEQ ID NO: 9773 - DNA, 15 bp, Homo sapiens
agtcttttatgattg

SEQ ID NO: 9774 - DNA, 15 bp, Homo sapiens
gtcttttatgattga

SEQ ID NO: 9775 - DNA, 15 bp, Homo sapiens
tcttttatgattgaa

SEQ ID NO: 9776 - DNA, 15 bp, Homo sapiens
cttttatgattgaaa

SEQ ID NO: 9777 - DNA, 15 bp, Homo sapiens
ttttatgattgaaat

SEQ ID NO: 9778 - DNA, 15 bp, Homo sapiens
tttatgattgaaata

SEQ ID NO: 9779 - DNA, 15 bp, Homo sapiens
ttatgattgaaataa

SEQ ID NO: 9780 - DNA, 15 bp, Homo sapiens
tatgattgaaataat

SEQ ID NO: 9781 - DNA, 15 bp, Homo sapiens
atgattgaaataatt

SEQ ID NO: 9782 - DNA, 15 bp, Homo sapiens
tgattgaaataattt

SEQ ID NO: 9783 - DNA, 15 bp, Homo sapiens
gattgaaataatttt

SEQ ID NO: 9784 - DNA, 15 bp, Homo sapiens
attgaaataattttg

SEQ ID NO: 9785 - DNA, 15 bp, Homo sapiens
ttgaaataattttgc

SEQ ID NO: 9786 - DNA, 15 bp, Homo sapiens
tgaaataattttgct

SEQ ID NO: 9787 - DNA, 15 bp, Homo sapiens
gaaataattttgcta

SEQ ID NO: 9788 - DNA, 15 bp, Homo sapiens
aaataattttgctaa

SEQ ID NO: 9789 - DNA, 15 bp, Homo sapiens
aataattttgctaaa

SEQ ID NO: 9790 - DNA, 15 bp, Homo sapiens
ataattttgctaaat

SEQ ID NO: 9791 - DNA, 15 bp, Homo sapiens
taattttgctaaata

SEQ ID NO: 9792 - DNA, 15 bp, Homo sapiens
aattttgctaaatag

SEQ ID NO: 9793 - DNA, 15 bp, Homo sapiens
attttgctaaataga

SEQ ID NO: 9794 - DNA, 15 bp, Homo sapiens
ttttgctaaatagac

SEQ ID NO: 9795 - DNA, 15 bp, Homo sapiens
tttgctaaatagact

SEQ ID NO: 9796 - DNA, 15 bp, Homo sapiens
ttgctaaatagactg

SEQ ID NO: 9797 - DNA, 15 bp, Homo sapiens
tgctaaatagactgt

SEQ ID NO: 9798 - DNA, 15 bp, Homo sapiens
gctaaatagactgtc

SEQ ID NO: 9799 - DNA, 15 bp, Homo sapiens
ctaaatagactgtct

SEQ ID NO: 9800 - DNA, 15 bp, Homo sapiens
taaatagactgtctc

SEQ ID NO: 9801 - DNA, 15 bp, Homo sapiens
aaatagactgtctct

SEQ ID NO: 9802 - DNA, 15 bp, Homo sapiens
aatagactgtctctg

SEQ ID NO: 9803 - DNA, 15 bp, Homo sapiens
atagactgtctctga

SEQ ID NO: 9804 - DNA, 15 bp, Homo sapiens
tagactgtctctgat

SEQ ID NO: 9805 - DNA, 15 bp, Homo sapiens
agactgtctctgatt

SEQ ID NO: 9806 - DNA, 15 bp, Homo sapiens
gactgtctctgattt

SEQ ID NO: 9807 - DNA, 15 bp, Homo sapiens
actgtctctgattta

SEQ ID NO: 9808 - DNA, 15 bp, Homo sapiens
ctgtctctgatttat

SEQ ID NO: 9809 - DNA, 15 bp, Homo sapiens
tgtctctgatttatt

SEQ ID NO: 9810 - DNA, 15 bp, Homo sapiens
gtctctgatttatta

SEQ ID NO: 9811 - DNA, 15 bp, Homo sapiens
tctctgatttattag

SEQ ID NO: 9812 - DNA, 15 bp, Homo sapiens
ctctgatttattagg

SEQ ID NO: 9813 - DNA, 15 bp, Homo sapiens
tctgatttattaggt

SEQ ID NO: 9814 - DNA, 15 bp, Homo sapiens
ctgatttattaggta

SEQ ID NO: 9815 - DNA, 15 bp, Homo sapiens
tgatttattaggtaa

SEQ ID NO: 9816 - DNA, 15 bp, Homo sapiens
gatttattaggtaat

SEQ ID NO: 9817 - DNA, 15 bp, Homo sapiens
atttattaggtaatc

SEQ ID NO: 9818 - DNA, 15 bp, Homo sapiens
tttattaggtaatca

SEQ ID NO: 9819 - DNA, 15 bp, Homo sapiens
ttattaggtaatcac

SEQ ID NO: 9820 - DNA, 15 bp, Homo sapiens
tattaggtaatcacc

SEQ ID NO: 9821 - DNA, 15 bp, Homo sapiens
attaggtaatcacca

SEQ ID NO: 9822 - DNA, 15 bp, Homo sapiens
ttaggtaatcaccac

SEQ ID NO: 9823 - DNA, 15 bp, Homo sapiens
taggtaatcaccact

SEQ ID NO: 9824 - DNA, 15 bp, Homo sapiens
aggtaatcaccactc

SEQ ID NO: 9825 - DNA, 15 bp, Homo sapiens
ggtaatcaccactct

SEQ ID NO: 9826 - DNA, 15 bp, Homo sapiens
gtaatcaccactctt

SEQ ID NO: 9827 - DNA, 15 bp, Homo sapiens
taatcaccactctta

SEQ ID NO: 9828 - DNA, 15 bp, Homo sapiens
aatcaccactcttat

SEQ ID NO: 9829 - DNA, 15 bp, Homo sapiens
atcaccactcttatt

SEQ ID NO: 9830 - DNA, 15 bp, Homo sapiens
tcaccactcttattt

SEQ ID NO: 9831 - DNA, 15 bp, Homo sapiens
caccactcttatttt

SEQ ID NO: 9832 - DNA, 15 bp, Homo sapiens
accactcttattttg

SEQ ID NO: 9833 - DNA, 15 bp, Homo sapiens
ccactcttattttgt

SEQ ID NO: 9834 - DNA, 15 bp, Homo sapiens
cactcttattttgtt

SEQ ID NO: 9835 - DNA, 15 bp, Homo sapiens
actcttattttgttt

SEQ ID NO: 9836 - DNA, 15 bp, Homo sapiens
ctcttattttgtttt

SEQ ID NO: 9837 - DNA, 15 bp, Homo sapiens
tcttattttgtttta

SEQ ID NO: 9838 - DNA, 15 bp, Homo sapiens
cttattttgttttac

SEQ ID NO: 9839 - DNA, 15 bp, Homo sapiens
ttattttgttttact

SEQ ID NO: 9840 - DNA, 15 bp, Homo sapiens
tattttgttttactt

SEQ ID NO: 9841 - DNA, 15 bp, Homo sapiens
attttgttttacttc

SEQ ID NO: 9842 - DNA, 15 bp, Homo sapiens
ttttgttttacttcc

SEQ ID NO: 9843 - DNA, 15 bp, Homo sapiens
tttgttttacttcct

SEQ ID NO: 9844 - DNA, 15 bp, Homo sapiens
ttgttttacttcctt

SEQ ID NO: 9845 - DNA, 15 bp, Homo sapiens
tgttttacttcctta

SEQ ID NO: 9846 - DNA, 15 bp, Homo sapiens
gttttacttccttaa

SEQ ID NO: 9847 - DNA, 15 bp, Homo sapiens
ttttacttccttaat

SEQ ID NO: 9848 - DNA, 15 bp, Homo sapiens
tttacttccttaatg

SEQ ID NO: 9849 - DNA, 15 bp, Homo sapiens
ttacttccttaatgt

SEQ ID NO: 9850 - DNA, 15 bp, Homo sapiens
tacttccttaatgtc

SEQ ID NO: 9851 - DNA, 15 bp, Homo sapiens
acttccttaatgtct

SEQ ID NO: 9852 - DNA, 15 bp, Homo sapiens
cttccttaatgtcta

SEQ ID NO: 9853 - DNA, 15 bp, Homo sapiens
ttccttaatgtctac

SEQ ID NO: 9854 - DNA, 15 bp, Homo sapiens
tccttaatgtctaca

SEQ ID NO: 9855 - DNA, 15 bp, Homo sapiens
ccttaatgtctacat

SEQ ID NO: 9856 - DNA, 15 bp, Homo sapiens
cttaatgtctacata

SEQ ID NO: 9857 - DNA, 15 bp, Homo sapiens
ttaatgtctacatag

SEQ ID NO: 9858 - DNA, 15 bp, Homo sapiens
taatgtctacataga

SEQ ID NO: 9859 - DNA, 15 bp, Homo sapiens
aatgtctacatagaa

SEQ ID NO: 9860 - DNA, 15 bp, Homo sapiens
atgtctacatagaaa

SEQ ID NO: 9861 - DNA, 15 bp, Homo sapiens
tgtctacatagaaag

SEQ ID NO: 9862 - DNA, 15 bp, Homo sapiens
gtctacatagaaagg

SEQ ID NO: 9863 - DNA, 15 bp, Homo sapiens
tctacatagaaagga

SEQ ID NO: 9864 - DNA, 15 bp, Homo sapiens
ctacatagaaaggaa

SEQ ID NO: 9865 - DNA, 15 bp, Homo sapiens
tacatagaaaggaaa

SEQ ID NO: 9866 - DNA, 15 bp, Homo sapiens
acatagaaaggaaat

SEQ ID NO: 9867 - DNA, 15 bp, Homo sapiens
catagaaaggaaatg

SEQ ID NO: 9868 - DNA, 15 bp, Homo sapiens
atagaaaggaaatga

SEQ ID NO: 9869 - DNA, 15 bp, Homo sapiens
tagaaaggaaatgag

SEQ ID NO: 9870 - DNA, 15 bp, Homo sapiens
agaaaggaaatgaga

SEQ ID NO: 9871 - DNA, 15 bp, Homo sapiens
gaaaggaaatgagaa

SEQ ID NO: 9872 - DNA, 15 bp, Homo sapiens
aaaggaaatgagaaa

SEQ ID NO: 9873 - DNA, 15 bp, Homo sapiens
aaggaaatgagaaaa

SEQ ID NO: 9874 - DNA, 15 bp, Homo sapiens
aggaaatgagaaaaa

SEQ ID NO: 9875 - DNA, 15 bp, Homo sapiens
ggaaatgagaaaaat

SEQ ID NO: 9876 - DNA, 15 bp, Homo sapiens
gaaatgagaaaaatc

SEQ ID NO: 9877 - DNA, 15 bp, Homo sapiens
aaatgagaaaaatcc

SEQ ID NO: 9878 - DNA, 15 bp, Homo sapiens
aatgagaaaaatcca

SEQ ID NO: 9879 - DNA, 15 bp, Homo sapiens
atgagaaaaatccag

SEQ ID NO: 9880 - DNA, 15 bp, Homo sapiens
tgagaaaaatccaga

SEQ ID NO: 9881 - DNA, 15 bp, Homo sapiens
gagaaaaatccagag

SEQ ID NO: 9882 - DNA, 15 bp, Homo sapiens
agaaaaatccagagg

SEQ ID NO: 9883 - DNA, 15 bp, Homo sapiens
gaaaaatccagaggt

SEQ ID NO: 9884 - DNA, 15 bp, Homo sapiens
aaaaatccagaggtt

SEQ ID NO: 9885 - DNA, 15 bp, Homo sapiens
aaaatccagaggttg

SEQ ID NO: 9886 - DNA, 15 bp, Homo sapiens
aaatccagaggttgt

SEQ ID NO: 9887 - DNA, 15 bp, Homo sapiens
aatccagaggttgtc

SEQ ID NO: 9888 - DNA, 15 bp, Homo sapiens
atccagaggttgtca

SEQ ID NO: 9889 - DNA, 15 bp, Homo sapiens
tccagaggttgtcat

SEQ ID NO: 9890 - DNA, 15 bp, Homo sapiens
ccagaggttgtcatt

SEQ ID NO: 9891 - DNA, 15 bp, Homo sapiens
cagaggttgtcattt

SEQ ID NO: 9892 - DNA, 15 bp, Homo sapiens
agaggttgtcatttg

SEQ ID NO: 9893 - DNA, 15 bp, Homo sapiens
gaggttgtcatttga

SEQ ID NO: 9894 - DNA, 15 bp, Homo sapiens
aggttgtcatttgac

SEQ ID NO: 9895 - DNA, 15 bp, Homo sapiens
ggttgtcatttgact

SEQ ID NO: 9896 - DNA, 15 bp, Homo sapiens
gttgtcatttgactt

SEQ ID NO: 9897 - DNA, 15 bp, Homo sapiens
ttgtcatttgactta

SEQ ID NO: 9898 - DNA, 15 bp, Homo sapiens
tgtcatttgacttat

SEQ ID NO: 9899 - DNA, 15 bp, Homo sapiens
gtcatttgacttatg

SEQ ID NO: 9900 - DNA, 15 bp, Homo sapiens
tcatttgacttatga

SEQ ID NO: 9901 - DNA, 15 bp, Homo sapiens
catttgacttatgag

SEQ ID NO: 9902 - DNA, 15 bp, Homo sapiens
atttgacttatgagt

SEQ ID NO: 9903 - DNA, 15 bp, Homo sapiens
tttgacttatgagtc

SEQ ID NO: 9904 - DNA, 15 bp, Homo sapiens
ttgacttatgagtct

SEQ ID NO: 9905 - DNA, 15 bp, Homo sapiens
tgacttatgagtctg

SEQ ID NO: 9906 - DNA, 15 bp, Homo sapiens
gacttatgagtctgt

SEQ ID NO: 9907 - DNA, 15 bp, Homo sapiens
acttatgagtctgtt

SEQ ID NO: 9908 - DNA, 15 bp, Homo sapiens
cttatgagtctgttt

SEQ ID NO: 9909 - DNA, 15 bp, Homo sapiens
ttatgagtctgtttg

SEQ ID NO: 9910 - DNA, 15 bp, Homo sapiens
tatgagtctgtttga

SEQ ID NO: 9911 - DNA, 15 bp, Homo sapiens
atgagtctgtttgac

SEQ ID NO: 9912 - DNA, 15 bp, Homo sapiens
tgagtctgtttgact

SEQ ID NO: 9913 - DNA, 15 bp, Homo sapiens
gagtctgtttgactt

SEQ ID NO: 9914 - DNA, 15 bp, Homo sapiens
agtctgtttgacttc

SEQ ID NO: 9915 - DNA, 15 bp, Homo sapiens
gtctgtttgacttca

SEQ ID NO: 9916 - DNA, 15 bp, Homo sapiens
tctgtttgacttcag

SEQ ID NO: 9917 - DNA, 15 bp, Homo sapiens
ctgtttgacttcagg

SEQ ID NO: 9918 - DNA, 15 bp, Homo sapiens
tgtttgacttcagga

SEQ ID NO: 9919 - DNA, 15 bp, Homo sapiens
gtttgacttcaggat

SEQ ID NO: 9920 - DNA, 15 bp, Homo sapiens
tttgacttcaggatt

SEQ ID NO: 9921 - DNA, 15 bp, Homo sapiens
ttgacttcaggattt

SEQ ID NO: 9922 - DNA, 15 bp, Homo sapiens
tgacttcaggatttg

SEQ ID NO: 9923 - DNA, 15 bp, Homo sapiens
gacttcaggatttgg

SEQ ID NO: 9924 - DNA, 15 bp, Homo sapiens
acttcaggatttggt

SEQ ID NO: 9925 - DNA, 15 bp, Homo sapiens
cttcaggatttggta

SEQ ID NO: 9926 - DNA, 15 bp, Homo sapiens
ttcaggatttggtac

SEQ ID NO: 9927 - DNA, 15 bp, Homo sapiens
tcaggatttggtaca

SEQ ID NO: 9928 - DNA, 15 bp, Homo sapiens
caggatttggtacat

SEQ ID NO: 9929 - DNA, 15 bp, Homo sapiens
aggatttggtacatg

SEQ ID NO: 9930 - DNA, 15 bp, Homo sapiens
ggatttggtacatga

SEQ ID NO: 9931 - DNA, 15 bp, Homo sapiens
gatttggtacatgaa

SEQ ID NO: 9932 - DNA, 15 bp, Homo sapiens
atttggtacatgaaa

SEQ ID NO: 9933 - DNA, 15 bp, Homo sapiens
tttggtacatgaaat

SEQ ID NO: 9934 - DNA, 15 bp, Homo sapiens
ttggtacatgaaatt

SEQ ID NO: 9935 - DNA, 15 bp, Homo sapiens
tggtacatgaaattt

SEQ ID NO: 9936 - DNA, 15 bp, Homo sapiens
ggtacatgaaatttc

SEQ ID NO: 9937 - DNA, 15 bp, Homo sapiens
gtacatgaaatttca

SEQ ID NO: 9938 - DNA, 15 bp, Homo sapiens
tacatgaaatttcac

SEQ ID NO: 9939 - DNA, 15 bp, Homo sapiens
acatgaaatttcact

SEQ ID NO: 9940 - DNA, 15 bp, Homo sapiens
catgaaatttcactt

SEQ ID NO: 9941 - DNA, 15 bp, Homo sapiens
atgaaatttcactta

SEQ ID NO: 9942 - DNA, 15 bp, Homo sapiens
tgaaatttcacttaa

SEQ ID NO: 9943 - DNA, 15 bp, Homo sapiens
gaaatttcacttaat

SEQ ID NO: 9944 - DNA, 15 bp, Homo sapiens
aaatttcacttaatc

SEQ ID NO: 9945 - DNA, 15 bp, Homo sapiens
aatttcacttaatct

SEQ ID NO: 9946 - DNA, 15 bp, Homo sapiens
atttcacttaatctt

SEQ ID NO: 9947 - DNA, 15 bp, Homo sapiens
tttcacttaatcttt

SEQ ID NO: 9948 - DNA, 15 bp, Homo sapiens
ttcacttaatctttt

SEQ ID NO: 9949 - DNA, 15 bp, Homo sapiens
tcacttaatcttttt

SEQ ID NO: 9950 - DNA, 15 bp, Homo sapiens
cacttaatctttttg

SEQ ID NO: 9951 - DNA, 15 bp, Homo sapiens
acttaatctttttga

SEQ ID NO: 9952 - DNA, 15 bp, Homo sapiens
cttaatctttttgat

SEQ ID NO: 9953 - DNA, 15 bp, Homo sapiens
ttaatctttttgata

SEQ ID NO: 9954 - DNA, 15 bp, Homo sapiens
taatctttttgatat

SEQ ID NO: 9955 - DNA, 15 bp, Homo sapiens
aatctttttgatatg

SEQ ID NO: 9956 - DNA, 15 bp, Homo sapiens
atctttttgatatgt

SEQ ID NO: 9957 - DNA, 15 bp, Homo sapiens
tctttttgatatgta

SEQ ID NO: 9958 - DNA, 15 bp, Homo sapiens
ctttttgatatgtat

SEQ ID NO: 9959 - DNA, 15 bp, Homo sapiens
tttttgatatgtata

SEQ ID NO: 9960 - DNA, 15 bp, Homo sapiens
ttttgatatgtataa

SEQ ID NO: 9961 - DNA, 15 bp, Homo sapiens
tttgatatgtataaa

SEQ ID NO: 9962 - DNA, 15 bp, Homo sapiens
ttgatatgtataaaa

SEQ ID NO: 9963 - DNA, 15 bp, Homo sapiens
tgatatgtataaaac

SEQ ID NO: 9964 - DNA, 15 bp, Homo sapiens
gatatgtataaaaca

SEQ ID NO: 9965 - DNA, 15 bp, Homo sapiens
atatgtataaaacaa

SEQ ID NO: 9966 - DNA, 15 bp, Homo sapiens
tatgtataaaacaaa

SEQ ID NO: 9967 - DNA, 15 bp, Homo sapiens
atgtataaaacaaat

SEQ ID NO: 9968 - DNA, 15 bp, Homo sapiens
tgtataaaacaaata

SEQ ID NO: 9969 - DNA, 15 bp, Homo sapiens
gtataaaacaaatat

SEQ ID NO: 9970 - DNA, 15 bp, Homo sapiens
tataaaacaaatatt

SEQ ID NO: 9971 - DNA, 15 bp, Homo sapiens
ataaaacaaatattc

SEQ ID NO: 9972 - DNA, 15 bp, Homo sapiens
taaaacaaatattct

SEQ ID NO: 9973 - DNA, 15 bp, Homo sapiens
aaaacaaatattctg

SEQ ID NO: 9974 - DNA, 15 bp, Homo sapiens
aaacaaatattctgg

SEQ ID NO: 9975 - DNA, 15 bp, Homo sapiens
aacaaatattctggg

SEQ ID NO: 9976 - DNA, 15 bp, Homo sapiens
acaaatattctgggt

SEQ ID NO: 9977 - DNA, 15 bp, Homo sapiens
caaatattctgggta

SEQ ID NO: 9978 - DNA, 15 bp, Homo sapiens
aaatattctgggtaa

SEQ ID NO: 9979 - DNA, 15 bp, Homo sapiens
aatattctgggtaat

SEQ ID NO: 9980 - DNA, 15 bp, Homo sapiens
atattctgggtaatt

SEQ ID NO: 9981 - DNA, 15 bp, Homo sapiens
tattctgggtaatta

SEQ ID NO: 9982 - DNA, 15 bp, Homo sapiens
attctgggtaattat

SEQ ID NO: 9983 - DNA, 15 bp, Homo sapiens
ttctgggtaattatt

SEQ ID NO: 9984 - DNA, 15 bp, Homo sapiens
tctgggtaattattt

SEQ ID NO: 9985 - DNA, 15 bp, Homo sapiens
ctgggtaattatttt

SEQ ID NO: 9986 - DNA, 15 bp, Homo sapiens
tgggtaattattttt

SEQ ID NO: 9987 - DNA, 15 bp, Homo sapiens
gggtaattattttta

SEQ ID NO: 9988 - DNA, 15 bp, Homo sapiens
ggtaattatttttat

SEQ ID NO: 9989 - DNA, 15 bp, Homo sapiens
gtaattatttttatc

SEQ ID NO: 9990 - DNA, 15 bp, Homo sapiens
taattatttttatcc

SEQ ID NO: 9991 - DNA, 15 bp, Homo sapiens
aattatttttatcct

SEQ ID NO: 9992 - DNA, 15 bp, Homo sapiens
attatttttatcctt

SEQ ID NO: 9993 - DNA, 15 bp, Homo sapiens
ttatttttatccttt

SEQ ID NO: 9994 - DNA, 15 bp, Homo sapiens
tatttttatcctttt

SEQ ID NO: 9995 - DNA, 15 bp, Homo sapiens
atttttatccttttg

SEQ ID NO: 9996 - DNA, 15 bp, Homo sapiens
tttttatccttttgg

SEQ ID NO: 9997 - DNA, 15 bp, Homo sapiens
ttttatccttttggt

SEQ ID NO: 9998 - DNA, 15 bp, Homo sapiens
tttatccttttggtt

SEQ ID NO: 9999 - DNA, 15 bp, Homo sapiens
ttatccttttggttt

SEQ ID NO: 10000 - DNA, 15 bp, Homo sapiens
tatccttttggtttt

SEQ ID NO: 10001 - DNA, 15 bp, Homo sapiens
atccttttggttttg

SEQ ID NO: 10002 - DNA, 15 bp, Homo sapiens
tccttttggttttga

SEQ ID NO: 10003 - DNA, 15 bp, Homo sapiens
ccttttggttttgag

SEQ ID NO: 10004 - DNA, 15 bp, Homo sapiens
cttttggttttgagt

SEQ ID NO: 10005 - DNA, 15 bp, Homo sapiens
ttttggttttgagtc

SEQ ID NO: 10006 - DNA, 15 bp, Homo sapiens
tttggttttgagtcc

SEQ ID NO: 10007 - DNA, 15 bp, Homo sapiens
ttggttttgagtcct

SEQ ID NO: 10008 - DNA, 15 bp, Homo sapiens
tggttttgagtcctt

SEQ ID NO: 10009 - DNA, 15 bp, Homo sapiens
ggttttgagtccttt

SEQ ID NO: 10010 - DNA, 15 bp, Homo sapiens
gttttgagtcctttt

SEQ ID NO: 10011 - DNA, 15 bp, Homo sapiens
ttttgagtccttttt

SEQ ID NO: 10012 - DNA, 15 bp, Homo sapiens
tttgagtccttttta

SEQ ID NO: 10013 - DNA, 15 bp, Homo sapiens
ttgagtcctttttat

SEQ ID NO: 10014 - DNA, 15 bp, Homo sapiens
tgagtcctttttatt

SEQ ID NO: 10015 - DNA, 15 bp, Homo sapiens
gagtcctttttattc

SEQ ID NO: 10016 - DNA, 15 bp, Homo sapiens
agtcctttttattcc

SEQ ID NO: 10017 - DNA, 15 bp, Homo sapiens
gtcctttttattcct

SEQ ID NO: 10018 - DNA, 15 bp, Homo sapiens
tcctttttattccta

SEQ ID NO: 10019 - DNA, 15 bp, Homo sapiens
cctttttattcctat

SEQ ID NO: 10020 - DNA, 15 bp, Homo sapiens
ctttttattcctatc

SEQ ID NO: 10021 - DNA, 15 bp, Homo sapiens
tttttattcctatca

SEQ ID NO: 10022 - DNA, 15 bp, Homo sapiens
ttttattcctatcat

SEQ ID NO: 10023 - DNA, 15 bp, Homo sapiens
tttattcctatcata

SEQ ID NO: 10024 - DNA, 15 bp, Homo sapiens
ttattcctatcatat

SEQ ID NO: 10025 - DNA, 15 bp, Homo sapiens
tattcctatcatatt

SEQ ID NO: 10026 - DNA, 15 bp, Homo sapiens
attcctatcatattg

SEQ ID NO: 10027 - DNA, 15 bp, Homo sapiens
ttcctatcatattga

SEQ ID NO: 10028 - DNA, 15 bp, Homo sapiens
tcctatcatattgaa

SEQ ID NO: 10029 - DNA, 15 bp, Homo sapiens
cctatcatattgaaa

SEQ ID NO: 10030 - DNA, 15 bp, Homo sapiens
ctatcatattgaaat

SEQ ID NO: 10031 - DNA, 15 bp, Homo sapiens
tatcatattgaaatt

SEQ ID NO: 10032 - DNA, 15 bp, Homo sapiens
atcatattgaaattg

SEQ ID NO: 10033 - DNA, 15 bp, Homo sapiens
tcatattgaaattgg

SEQ ID NO: 10034 - DNA, 15 bp, Homo sapiens
catattgaaattggt

SEQ ID NO: 10035 - DNA, 15 bp, Homo sapiens
atattgaaattggta

SEQ ID NO: 10036 - DNA, 15 bp, Homo sapiens
tattgaaattggtaa

SEQ ID NO: 10037 - DNA, 15 bp, Homo sapiens
attgaaattggtaag

SEQ ID NO: 10038 - DNA, 15 bp, Homo sapiens
ttgaaattggtaagt

SEQ ID NO: 10039 - DNA, 15 bp, Homo sapiens
tgaaattggtaagtt

SEQ ID NO: 10040 - DNA, 15 bp, Homo sapiens
gaaattggtaagtta

SEQ ID NO: 10041 - DNA, 15 bp, Homo sapiens
aaattggtaagttaa

SEQ ID NO: 10042 - DNA, 15 bp, Homo sapiens
aattggtaagttaat

SEQ ID NO: 10043 - DNA, 15 bp, Homo sapiens
attggtaagttaatt

SEQ ID NO: 10044 - DNA, 15 bp, Homo sapiens
ttggtaagttaattt

SEQ ID NO: 10045 - DNA, 15 bp, Homo sapiens
tggtaagttaatttt

SEQ ID NO: 10046 - DNA, 15 bp, Homo sapiens
ggtaagttaattttc

SEQ ID NO: 10047 - DNA, 15 bp, Homo sapiens
gtaagttaattttcc

SEQ ID NO: 10048 - DNA, 15 bp, Homo sapiens
taagttaattttcct

SEQ ID NO: 10049 - DNA, 15 bp, Homo sapiens
aagttaattttcctt

SEQ ID NO: 10050 - DNA, 15 bp, Homo sapiens
agttaattttccttt

SEQ ID NO: 10051 - DNA, 15 bp, Homo sapiens
gttaattttcctttg

SEQ ID NO: 10052 - DNA, 15 bp, Homo sapiens
ttaattttcctttga

SEQ ID NO: 10053 - DNA, 15 bp, Homo sapiens
taattttcctttgaa

SEQ ID NO: 10054 - DNA, 15 bp, Homo sapiens
aattttcctttgaaa

SEQ ID NO: 10055 - DNA, 15 bp, Homo sapiens
attttcctttgaaat

SEQ ID NO: 10056 - DNA, 15 bp, Homo sapiens
ttttcctttgaaata

SEQ ID NO: 10057 - DNA, 15 bp, Homo sapiens
tttcctttgaaatat

SEQ ID NO: 10058 - DNA, 15 bp, Homo sapiens
ttcctttgaaatatt

SEQ ID NO: 10059 - DNA, 15 bp, Homo sapiens
tcctttgaaatattc

SEQ ID NO: 10060 - DNA, 15 bp, Homo sapiens
cctttgaaatattcc

SEQ ID NO: 10061 - DNA, 15 bp, Homo sapiens
ctttgaaatattcct

SEQ ID NO: 10062 - DNA, 15 bp, Homo sapiens
tttgaaatattcctt

SEQ ID NO: 10063 - DNA, 15 bp, Homo sapiens
ttgaaatattcctta

SEQ ID NO: 10064 - DNA, 15 bp, Homo sapiens
tgaaatattccttat

SEQ ID NO: 10065 - DNA, 15 bp, Homo sapiens
gaaatattccttata

SEQ ID NO: 10066 - DNA, 15 bp, Homo sapiens
aaatattccttatag

SEQ ID NO: 10067 - DNA, 15 bp, Homo sapiens
aatattccttatagc

SEQ ID NO: 10068 - DNA, 15 bp, Homo sapiens
atattccttatagcc

SEQ ID NO: 10069 - DNA, 15 bp, Homo sapiens
tattccttatagcca

SEQ ID NO: 10070 - DNA, 15 bp, Homo sapiens
attccttatagccag

SEQ ID NO: 10071 - DNA, 15 bp, Homo sapiens
ttccttatagccagg

SEQ ID NO: 10072 - DNA, 15 bp, Homo sapiens
tccttatagccaggt

SEQ ID NO: 10073 - DNA, 15 bp, Homo sapiens
ccttatagccaggtc

SEQ ID NO: 10074 - DNA, 15 bp, Homo sapiens
cttatagccaggtct

SEQ ID NO: 10075 - DNA, 15 bp, Homo sapiens
ttatagccaggtcta

SEQ ID NO: 10076 - DNA, 15 bp, Homo sapiens
tatagccaggtctaa

SEQ ID NO: 10077 - DNA, 15 bp, Homo sapiens
atagccaggtctaaa

SEQ ID NO: 10078 - DNA, 15 bp, Homo sapiens
tagccaggtctaaaa

SEQ ID NO: 10079 - DNA, 15 bp, Homo sapiens
agccaggtctaaaat

SEQ ID NO: 10080 - DNA, 15 bp, Homo sapiens
gccaggtctaaaatt

SEQ ID NO: 10081 - DNA, 15 bp, Homo sapiens
ccaggtctaaaattc

SEQ ID NO: 10082 - DNA, 15 bp, Homo sapiens
caggtctaaaattca

SEQ ID NO: 10083 - DNA, 15 bp, Homo sapiens
aggtctaaaattcaa

SEQ ID NO: 10084 - DNA, 15 bp, Homo sapiens
ggtctaaaattcaat

SEQ ID NO: 10085 - DNA, 15 bp, Homo sapiens
gtctaaaattcaatg

SEQ ID NO: 10086 - DNA, 15 bp, Homo sapiens
tctaaaattcaatgg

SEQ ID NO: 10087 - DNA, 15 bp, Homo sapiens
ctaaaattcaatggc

SEQ ID NO: 10088 - DNA, 15 bp, Homo sapiens
taaaattcaatggcc

SEQ ID NO: 10089 - DNA, 15 bp, Homo sapiens
aaaattcaatggccc

SEQ ID NO: 10090 - DNA, 15 bp, Homo sapiens
aaattcaatggccca

SEQ ID NO: 10091 - DNA, 15 bp, Homo sapiens
aattcaatggcccac

SEQ ID NO: 10092 - DNA, 15 bp, Homo sapiens
attcaatggcccacc

SEQ ID NO: 10093 - DNA, 15 bp, Homo sapiens
ttcaatggcccacca

SEQ ID NO: 10094 - DNA, 15 bp, Homo sapiens
tcaatggcccaccac

SEQ ID NO: 10095 - DNA, 15 bp, Homo sapiens
caatggcccaccacc

SEQ ID NO: 10096 - DNA, 15 bp, Homo sapiens
aatggcccaccaccg

SEQ ID NO: 10097 - DNA, 15 bp, Homo sapiens
atggcccaccaccgc

SEQ ID NO: 10098 - DNA, 15 bp, Homo sapiens
tggcccaccaccgcc

SEQ ID NO: 10099 - DNA, 15 bp, Homo sapiens
ggcccaccaccgcca

SEQ ID NO: 10100 - DNA, 15 bp, Homo sapiens
gcccaccaccgccac

SEQ ID NO: 10101 - DNA, 15 bp, Homo sapiens
cccaccaccgccacc

SEQ ID NO: 10102 - DNA, 15 bp, Homo sapiens
ccaccaccgccaccg

SEQ ID NO: 10103 - DNA, 15 bp, Homo sapiens
caccaccgccaccgc

SEQ ID NO: 10104 - DNA, 15 bp, Homo sapiens
accaccgccaccgcc

SEQ ID NO: 10105 - DNA, 15 bp, Homo sapiens
ccaccgccaccgcca

SEQ ID NO: 10106 - DNA, 15 bp, Homo sapiens
caccgccaccgccac

SEQ ID NO: 10107 - DNA, 15 bp, Homo sapiens
accgccaccgccacc

SEQ ID NO: 10108 - DNA, 15 bp, Homo sapiens
ccgccaccgccacca

SEQ ID NO: 10109 - DNA, 15 bp, Homo sapiens
cgccaccgccaccac

SEQ ID NO: 10110 - DNA, 15 bp, Homo sapiens
gccaccgccaccacc

SEQ ID NO: 10111 - DNA, 15 bp, Homo sapiens
ccaccgccaccacca

SEQ ID NO: 10112 - DNA, 15 bp, Homo sapiens
caccgccaccaccac

SEQ ID NO: 10113 - DNA, 15 bp, Homo sapiens
accgccaccaccacc

SEQ ID NO: 10114 - DNA, 15 bp, Homo sapiens
ccgccaccaccacca

SEQ ID NO: 10115 - DNA, 15 bp, Homo sapiens
cgccaccaccaccac

SEQ ID NO: 10116 - DNA, 15 bp, Homo sapiens
gccaccaccaccacc

SEQ ID NO: 10117 - DNA, 15 bp, Homo sapiens
ccaccaccaccaccc

SEQ ID NO: 10118 - DNA, 15 bp, Homo sapiens
caccaccaccacccc

SEQ ID NO: 10119 - DNA, 15 bp, Homo sapiens
accaccaccacccca

SEQ ID NO: 10120 - DNA, 15 bp, Homo sapiens
ccaccaccaccccac

SEQ ID NO: 10121 - DNA, 15 bp, Homo sapiens
caccaccaccccact

SEQ ID NO: 10122 - DNA, 15 bp, Homo sapiens
accaccaccccactt

SEQ ID NO: 10123 - DNA, 15 bp, Homo sapiens
ccaccaccccactta

SEQ ID NO: 10124 - DNA, 15 bp, Homo sapiens
caccaccccacttac

SEQ ID NO: 10125 - DNA, 15 bp, Homo sapiens
accaccccacttact

SEQ ID NO: 10126 - DNA, 15 bp, Homo sapiens
ccaccccacttacta

SEQ ID NO: 10127 - DNA, 15 bp, Homo sapiens
caccccacttactat

SEQ ID NO: 10128 - DNA, 15 bp, Homo sapiens
accccacttactatc

SEQ ID NO: 10129 - DNA, 15 bp, Homo sapiens
ccccacttactatca

SEQ ID NO: 10130 - DNA, 15 bp, Homo sapiens
cccacttactatcat

SEQ ID NO: 10131 - DNA, 15 bp, Homo sapiens
ccacttactatcatg

SEQ ID NO: 10132 - DNA, 15 bp, Homo sapiens
cacttactatcatgc

SEQ ID NO: 10133 - DNA, 15 bp, Homo sapiens
acttactatcatgct

SEQ ID NO: 10134 - DNA, 15 bp, Homo sapiens
cttactatcatgctg

SEQ ID NO: 10135 - DNA, 15 bp, Homo sapiens
ttactatcatgctgg

SEQ ID NO: 10136 - DNA, 15 bp, Homo sapiens
tactatcatgctggc

SEQ ID NO: 10137 - DNA, 15 bp, Homo sapiens
actatcatgctggct

SEQ ID NO: 10138 - DNA, 15 bp, Homo sapiens
ctatcatgctggctg

SEQ ID NO: 10139 - DNA, 15 bp, Homo sapiens
tatcatgctggctgc

SEQ ID NO: 10140 - DNA, 15 bp, Homo sapiens
atcatgctggctgcc

SEQ ID NO: 10141 - DNA, 15 bp, Homo sapiens
tcatgctggctgcct

SEQ ID NO: 10142 - DNA, 15 bp, Homo sapiens
catgctggctgcctc

SEQ ID NO: 10143 - DNA, 15 bp, Homo sapiens
atgctggctgcctcc

SEQ ID NO: 10144 - DNA, 15 bp, Homo sapiens
tgctggctgcctcca

SEQ ID NO: 10145 - DNA, 15 bp, Homo sapiens
gctggctgcctccat

SEQ ID NO: 10146 - DNA, 15 bp, Homo sapiens
ctggctgcctccatt

SEQ ID NO: 10147 - DNA, 15 bp, Homo sapiens
tggctgcctccattt

SEQ ID NO: 10148 - DNA, 15 bp, Homo sapiens
ggctgcctccatttc

SEQ ID NO: 10149 - DNA, 15 bp, Homo sapiens
gctgcctccatttcc

SEQ ID NO: 10150 - DNA, 15 bp, Homo sapiens
ctgcctccatttcct

SEQ ID NO: 10151 - DNA, 15 bp, Homo sapiens
tgcctccatttcctt

SEQ ID NO: 10152 - DNA, 15 bp, Homo sapiens
gcctccatttccttc

SEQ ID NO: 10153 - DNA, 15 bp, Homo sapiens
cctccatttccttct

SEQ ID NO: 10154 - DNA, 15 bp, Homo sapiens
ctccatttccttctg

SEQ ID NO: 10155 - DNA, 15 bp, Homo sapiens
tccatttccttctgg

SEQ ID NO: 10156 - DNA, 15 bp, Homo sapiens
ccatttccttctgga

SEQ ID NO: 10157 - DNA, 15 bp, Homo sapiens
catttccttctggac

SEQ ID NO: 10158 - DNA, 15 bp, Homo sapiens
atttccttctggacc

SEQ ID NO: 10159 - DNA, 15 bp, Homo sapiens
tttccttctggacca

SEQ ID NO: 10160 - DNA, 15 bp, Homo sapiens
ttccttctggaccac

SEQ ID NO: 10161 - DNA, 15 bp, Homo sapiens
tccttctggaccacc

SEQ ID NO: 10162 - DNA, 15 bp, Homo sapiens
ccttctggaccacca

SEQ ID NO: 10163 - DNA, 15 bp, Homo sapiens
cttctggaccaccag

SEQ ID NO: 10164 - DNA, 15 bp, Homo sapiens
ttctggaccaccagt

SEQ ID NO: 10165 - DNA, 15 bp, Homo sapiens
tctggaccaccagta

SEQ ID NO: 10166 - DNA, 15 bp, Homo sapiens
ctggaccaccagtaa

SEQ ID NO: 10167 - DNA, 15 bp, Homo sapiens
tggaccaccagtaag

SEQ ID NO: 10168 - DNA, 15 bp, Homo sapiens
ggaccaccagtaagt

SEQ ID NO: 10169 - DNA, 15 bp, Homo sapiens
gaccaccagtaagta

SEQ ID NO: 10170 - DNA, 15 bp, Homo sapiens
accaccagtaagtaa

SEQ ID NO: 10171 - DNA, 15 bp, Homo sapiens
ccaccagtaagtaaa

SEQ ID NO: 10172 - DNA, 15 bp, Homo sapiens
caccagtaagtaaaa

SEQ ID NO: 10173 - DNA, 15 bp, Homo sapiens
accagtaagtaaaaa

SEQ ID NO: 10174 - DNA, 15 bp, Homo sapiens
ccagtaagtaaaaaa

SEQ ID NO: 10175 - DNA, 15 bp, Homo sapiens
cagtaagtaaaaaag

SEQ ID NO: 10176 - DNA, 15 bp, Homo sapiens
agtaagtaaaaaaga

SEQ ID NO: 10177 - DNA, 15 bp, Homo sapiens
gtaagtaaaaaagag

SEQ ID NO: 10178 - DNA, 15 bp, Homo sapiens
taagtaaaaaagagt

SEQ ID NO: 10179 - DNA, 15 bp, Homo sapiens
aagtaaaaaagagta

SEQ ID NO: 10180 - DNA, 15 bp, Homo sapiens
agtaaaaaagagtat

SEQ ID NO: 10181 - DNA, 15 bp, Homo sapiens
gtaaaaaagagtata

SEQ ID NO: 10182 - DNA, 15 bp, Homo sapiens
taaaaaagagtatag

SEQ ID NO: 10183 - DNA, 15 bp, Homo sapiens
aaaaaagagtatagg

SEQ ID NO: 10184 - DNA, 15 bp, Homo sapiens
aaaaagagtataggt

SEQ ID NO: 10185 - DNA, 15 bp, Homo sapiens
aaaagagtataggtt

SEQ ID NO: 10186 - DNA, 15 bp, Homo sapiens
aaagagtataggtta

SEQ ID NO: 10187 - DNA, 15 bp, Homo sapiens
aagagtataggttag

SEQ ID NO: 10188 - DNA, 15 bp, Homo sapiens
agagtataggttaga

SEQ ID NO: 10189 - DNA, 15 bp, Homo sapiens
gagtataggttagat

SEQ ID NO: 10190 - DNA, 15 bp, Homo sapiens
agtataggttagatt

SEQ ID NO: 10191 - DNA, 15 bp, Homo sapiens
gtataggttagattt

SEQ ID NO: 10192 - DNA, 15 bp, Homo sapiens
tataggttagatttt

SEQ ID NO: 10193 - DNA, 15 bp, Homo sapiens
ataggttagattttg

SEQ ID NO: 10194 - DNA, 15 bp, Homo sapiens
taggttagattttgc

SEQ ID NO: 10195 - DNA, 15 bp, Homo sapiens
aggttagattttgct

SEQ ID NO: 10196 - DNA, 15 bp, Homo sapiens
ggttagattttgctt

SEQ ID NO: 10197 - DNA, 15 bp, Homo sapiens
gttagattttgcttt

SEQ ID NO: 10198 - DNA, 15 bp, Homo sapiens
ttagattttgctttc

SEQ ID NO: 10199 - DNA, 15 bp, Homo sapiens
tagattttgctttca

SEQ ID NO: 10200 - DNA, 15 bp, Homo sapiens
agattttgctttcac

SEQ ID NO: 10201 - DNA, 15 bp, Homo sapiens
gattttgctttcaca

SEQ ID NO: 10202 - DNA, 15 bp, Homo sapiens
attttgctttcacat

SEQ ID NO: 10203 - DNA, 15 bp, Homo sapiens
ttttgctttcacata

SEQ ID NO: 10204 - DNA, 15 bp, Homo sapiens
tttgctttcacatac

SEQ ID NO: 10205 - DNA, 15 bp, Homo sapiens
ttgctttcacataca

SEQ ID NO: 10206 - DNA, 15 bp, Homo sapiens
tgctttcacatacaa

SEQ ID NO: 10207 - DNA, 15 bp, Homo sapiens
gctttcacatacaat

SEQ ID NO: 10208 - DNA, 15 bp, Homo sapiens
ctttcacatacaatt

SEQ ID NO: 10209 - DNA, 15 bp, Homo sapiens
tttcacatacaattt

SEQ ID NO: 10210 - DNA, 15 bp, Homo sapiens
ttcacatacaatttg

SEQ ID NO: 10211 - DNA, 15 bp, Homo sapiens
tcacatacaatttga

SEQ ID NO: 10212 - DNA, 15 bp, Homo sapiens
cacatacaatttgat

SEQ ID NO: 10213 - DNA, 15 bp, Homo sapiens
acatacaatttgata

SEQ ID NO: 10214 - DNA, 15 bp, Homo sapiens
catacaatttgataa

SEQ ID NO: 10215 - DNA, 15 bp, Homo sapiens
atacaatttgataat

SEQ ID NO: 10216 - DNA, 15 bp, Homo sapiens
tacaatttgataatt

SEQ ID NO: 10217 - DNA, 15 bp, Homo sapiens
acaatttgataatta

SEQ ID NO: 10218 - DNA, 15 bp, Homo sapiens
caatttgataattag

SEQ ID NO: 10219 - DNA, 15 bp, Homo sapiens
aatttgataattagc

SEQ ID NO: 10220 - DNA, 15 bp, Homo sapiens
atttgataattagca

SEQ ID NO: 10221 - DNA, 15 bp, Homo sapiens
tttgataattagcag

SEQ ID NO: 10222 - DNA, 15 bp, Homo sapiens
ttgataattagcaga

SEQ ID NO: 10223 - DNA, 15 bp, Homo sapiens
tgataattagcagaa

SEQ ID NO: 10224 - DNA, 15 bp, Homo sapiens
gataattagcagaat

SEQ ID NO: 10225 - DNA, 15 bp, Homo sapiens
ataattagcagaata

SEQ ID NO: 10226 - DNA, 15 bp, Homo sapiens
taattagcagaatag

SEQ ID NO: 10227 - DNA, 15 bp, Homo sapiens
aattagcagaataga

SEQ ID NO: 10228 - DNA, 15 bp, Homo sapiens
attagcagaatagag

SEQ ID NO: 10229 - DNA, 15 bp, Homo sapiens
ttagcagaatagagg

SEQ ID NO: 10230 - DNA, 15 bp, Homo sapiens
tagcagaatagagga

SEQ ID NO: 10231 - DNA, 15 bp, Homo sapiens
agcagaatagaggat

SEQ ID NO: 10232 - DNA, 15 bp, Homo sapiens
gcagaatagaggatt

SEQ ID NO: 10233 - DNA, 15 bp, Homo sapiens
cagaatagaggattg

SEQ ID NO: 10234 - DNA, 15 bp, Homo sapiens
agaatagaggattgt

SEQ ID NO: 10235 - DNA, 15 bp, Homo sapiens
gaatagaggattgta

SEQ ID NO: 10236 - DNA, 15 bp, Homo sapiens
aatagaggattgtaa

SEQ ID NO: 10237 - DNA, 15 bp, Homo sapiens
atagaggattgtaaa

SEQ ID NO: 10238 - DNA, 15 bp, Homo sapiens
tagaggattgtaaaa

SEQ ID NO: 10239 - DNA, 15 bp, Homo sapiens
agaggattgtaaaat

SEQ ID NO: 10240 - DNA, 15 bp, Homo sapiens
gaggattgtaaaatg

SEQ ID NO: 10241 - DNA, 15 bp, Homo sapiens
aggattgtaaaatgt

SEQ ID NO: 10242 - DNA, 15 bp, Homo sapiens
ggattgtaaaatgtc

SEQ ID NO: 10243 - DNA, 15 bp, Homo sapiens
gattgtaaaatgtca

SEQ ID NO: 10244 - DNA, 15 bp, Homo sapiens
attgtaaaatgtcat

SEQ ID NO: 10245 - DNA, 15 bp, Homo sapiens
ttgtaaaatgtcatt

SEQ ID NO: 10246 - DNA, 15 bp, Homo sapiens
tgtaaaatgtcattg

SEQ ID NO: 10247 - DNA, 15 bp, Homo sapiens
gtaaaatgtcattgt

SEQ ID NO: 10248 - DNA, 15 bp, Homo sapiens
taaaatgtcattgta

SEQ ID NO: 10249 - DNA, 15 bp, Homo sapiens
aaaatgtcattgtag

SEQ ID NO: 10250 - DNA, 15 bp, Homo sapiens
aaatgtcattgtaga

SEQ ID NO: 10251 - DNA, 15 bp, Homo sapiens
aatgtcattgtagaa

SEQ ID NO: 10252 - DNA, 15 bp, Homo sapiens
atgtcattgtagaac

SEQ ID NO: 10253 - DNA, 15 bp, Homo sapiens
tgtcattgtagaaca

SEQ ID NO: 10254 - DNA, 15 bp, Homo sapiens
gtcattgtagaacat

SEQ ID NO: 10255 - DNA, 15 bp, Homo sapiens
tcattgtagaacatc

SEQ ID NO: 10256 - DNA, 15 bp, Homo sapiens
cattgtagaacatcc

SEQ ID NO: 10257 - DNA, 15 bp, Homo sapiens
attgtagaacatccc

SEQ ID NO: 10258 - DNA, 15 bp, Homo sapiens
ttgtagaacatccct

SEQ ID NO: 10259 - DNA, 15 bp, Homo sapiens
tgtagaacatccctt

SEQ ID NO: 10260 - DNA, 15 bp, Homo sapiens
gtagaacatcccttg

SEQ ID NO: 10261 - DNA, 15 bp, Homo sapiens
tagaacatcccttgg

SEQ ID NO: 10262 - DNA, 15 bp, Homo sapiens
agaacatcccttggg

SEQ ID NO: 10263 - DNA, 15 bp, Homo sapiens
gaacatcccttgggc

SEQ ID NO: 10264 - DNA, 15 bp, Homo sapiens
aacatcccttgggcc

SEQ ID NO: 10265 - DNA, 15 bp, Homo sapiens
acatcccttgggcca

SEQ ID NO: 10266 - DNA, 15 bp, Homo sapiens
catcccttgggccag

SEQ ID NO: 10267 - DNA, 15 bp, Homo sapiens
atcccttgggccaga

SEQ ID NO: 10268 - DNA, 15 bp, Homo sapiens
tcccttgggccagat

SEQ ID NO: 10269 - DNA, 15 bp, Homo sapiens
cccttgggccagatt

SEQ ID NO: 10270 - DNA, 15 bp, Homo sapiens
ccttgggccagattc

SEQ ID NO: 10271 - DNA, 15 bp, Homo sapiens
cttgggccagattct

SEQ ID NO: 10272 - DNA, 15 bp, Homo sapiens
ttgggccagattcta

SEQ ID NO: 10273 - DNA, 15 bp, Homo sapiens
tgggccagattctaa

SEQ ID NO: 10274 - DNA, 15 bp, Homo sapiens
gggccagattctaat

SEQ ID NO: 10275 - DNA, 15 bp, Homo sapiens
ggccagattctaatg

SEQ ID NO: 10276 - DNA, 15 bp, Homo sapiens
gccagattctaatgg

SEQ ID NO: 10277 - DNA, 15 bp, Homo sapiens
ccagattctaatggg

SEQ ID NO: 10278 - DNA, 15 bp, Homo sapiens
cagattctaatgggt

SEQ ID NO: 10279 - DNA, 15 bp, Homo sapiens
agattctaatgggta

SEQ ID NO: 10280 - DNA, 15 bp, Homo sapiens
gattctaatgggtag

SEQ ID NO: 10281 - DNA, 15 bp, Homo sapiens
attctaatgggtaga

SEQ ID NO: 10282 - DNA, 15 bp, Homo sapiens
ttctaatgggtagaa

SEQ ID NO: 10283 - DNA, 15 bp, Homo sapiens
tctaatgggtagaaa

SEQ ID NO: 10284 - DNA, 15 bp, Homo sapiens
ctaatgggtagaaat

SEQ ID NO: 10285 - DNA, 15 bp, Homo sapiens
taatgggtagaaatt

SEQ ID NO: 10286 - DNA, 15 bp, Homo sapiens
aatgggtagaaattt

SEQ ID NO: 10287 - DNA, 15 bp, Homo sapiens
atgggtagaaatttg

SEQ ID NO: 10288 - DNA, 15 bp, Homo sapiens
tgggtagaaatttga

SEQ ID NO: 10289 - DNA, 15 bp, Homo sapiens
gggtagaaatttgaa

SEQ ID NO: 10290 - DNA, 15 bp, Homo sapiens
ggtagaaatttgaac

SEQ ID NO: 10291 - DNA, 15 bp, Homo sapiens
gtagaaatttgaact

SEQ ID NO: 10292 - DNA, 15 bp, Homo sapiens
tagaaatttgaacta

SEQ ID NO: 10293 - DNA, 15 bp, Homo sapiens
agaaatttgaactaa

SEQ ID NO: 10294 - DNA, 15 bp, Homo sapiens
gaaatttgaactaaa

SEQ ID NO: 10295 - DNA, 15 bp, Homo sapiens
aaatttgaactaaac

SEQ ID NO: 10296 - DNA, 15 bp, Homo sapiens
aatttgaactaaacc

SEQ ID NO: 10297 - DNA, 15 bp, Homo sapiens
atttgaactaaacct

SEQ ID NO: 10298 - DNA, 15 bp, Homo sapiens
tttgaactaaacctc

SEQ ID NO: 10299 - DNA, 15 bp, Homo sapiens
ttgaactaaacctct

SEQ ID NO: 10300 - DNA, 15 bp, Homo sapiens
tgaactaaacctctg

SEQ ID NO: 10301 - DNA, 15 bp, Homo sapiens
gaactaaacctctgg

SEQ ID NO: 10302 - DNA, 15 bp, Homo sapiens
aactaaacctctggg

SEQ ID NO: 10303 - DNA, 15 bp, Homo sapiens
actaaacctctgggt

SEQ ID NO: 10304 - DNA, 15 bp, Homo sapiens
ctaaacctctgggtt

SEQ ID NO: 10305 - DNA, 15 bp, Homo sapiens
taaacctctgggttt

SEQ ID NO: 10306 - DNA, 15 bp, Homo sapiens
aaacctctgggtttt

SEQ ID NO: 10307 - DNA, 15 bp, Homo sapiens
aacctctgggttttg

SEQ ID NO: 10308 - DNA, 15 bp, Homo sapiens
acctctgggttttgt

SEQ ID NO: 10309 - DNA, 15 bp, Homo sapiens
cctctgggttttgtt

SEQ ID NO: 10310 - DNA, 15 bp, Homo sapiens
ctctgggttttgttt

SEQ ID NO: 10311 - DNA, 15 bp, Homo sapiens
tctgggttttgtttg

SEQ ID NO: 10312 - DNA, 15 bp, Homo sapiens
ctgggttttgtttgt

SEQ ID NO: 10313 - DNA, 15 bp, Homo sapiens
tgggttttgtttgtt

SEQ ID NO: 10314 - DNA, 15 bp, Homo sapiens
gggttttgtttgttt

SEQ ID NO: 10315 - DNA, 15 bp, Homo sapiens
ggttttgtttgtttt

SEQ ID NO: 10316 - DNA, 15 bp, Homo sapiens
ttttgtttgttttta

SEQ ID NO: 10317 - DNA, 15 bp, Homo sapiens
tttgtttgtttttaa

SEQ ID NO: 10318 - DNA, 15 bp, Homo sapiens
ttgtttgtttttaat

SEQ ID NO: 10319 - DNA, 15 bp, Homo sapiens
tgtttgtttttaatg

SEQ ID NO: 10320 - DNA, 15 bp, Homo sapiens
gtttgtttttaatgc

SEQ ID NO: 10321 - DNA, 15 bp, Homo sapiens
tttgtttttaatgcc

SEQ ID NO: 10322 - DNA, 15 bp, Homo sapiens
ttgtttttaatgcct

SEQ ID NO: 10323 - DNA, 15 bp, Homo sapiens
tgtttttaatgcctt

SEQ ID NO: 10324 - DNA, 15 bp, Homo sapiens
gtttttaatgccttt

SEQ ID NO: 10325 - DNA, 15 bp, Homo sapiens
tttttaatgcctttc

SEQ ID NO: 10326 - DNA, 15 bp, Homo sapiens
ttttaatgcctttct

SEQ ID NO: 10327 - DNA, 15 bp, Homo sapiens
tttaatgcctttctg

SEQ ID NO: 10328 - DNA, 15 bp, Homo sapiens
ttaatgcctttctgt

SEQ ID NO: 10329 - DNA, 15 bp, Homo sapiens
taatgcctttctgtt

SEQ ID NO: 10330 - DNA, 15 bp, Homo sapiens
aatgcctttctgtta

SEQ ID NO: 10331 - DNA, 15 bp, Homo sapiens
atgcctttctgttac

SEQ ID NO: 10332 - DNA, 15 bp, Homo sapiens
tgcctttctgttacc

SEQ ID NO: 10333 - DNA, 15 bp, Homo sapiens
gcctttctgttaccc

SEQ ID NO: 10334 - DNA, 15 bp, Homo sapiens
cctttctgttaccca

SEQ ID NO: 10335 - DNA, 15 bp, Homo sapiens
ctttctgttacccag

SEQ ID NO: 10336 - DNA, 15 bp, Homo sapiens
tttctgttacccaga

SEQ ID NO: 10337 - DNA, 15 bp, Homo sapiens
ttctgttacccagat

SEQ ID NO: 10338 - DNA, 15 bp, Homo sapiens
tctgttacccagatg

SEQ ID NO: 10339 - DNA, 15 bp, Homo sapiens
ctgttacccagatgc

SEQ ID NO: 10340 - DNA, 15 bp, Homo sapiens
tgttacccagatgca

SEQ ID NO: 10341 - DNA, 15 bp, Homo sapiens
gttacccagatgcag

SEQ ID NO: 10342 - DNA, 15 bp, Homo sapiens
ttacccagatgcagt

SEQ ID NO: 10343 - DNA, 15 bp, Homo sapiens
tacccagatgcagtg

SEQ ID NO: 10344 - DNA, 15 bp, Homo sapiens
acccagatgcagtgc

SEQ ID NO: 10345 - DNA, 15 bp, Homo sapiens
cccagatgcagtgct

SEQ ID NO: 10346 - DNA, 15 bp, Homo sapiens
ccagatgcagtgctc

SEQ ID NO: 10347 - DNA, 15 bp, Homo sapiens
cagatgcagtgctct

SEQ ID NO: 10348 - DNA, 15 bp, Homo sapiens
agatgcagtgctctt

SEQ ID NO: 10349 - DNA, 15 bp, Homo sapiens
gatgcagtgctcttg

SEQ ID NO: 10350 - DNA, 15 bp, Homo sapiens
atgcagtgctcttgt

SEQ ID NO: 10351 - DNA, 15 bp, Homo sapiens
tgcagtgctcttgta

SEQ ID NO: 10352 - DNA, 15 bp, Homo sapiens
gcagtgctcttgtag

SEQ ID NO: 10353 - DNA, 15 bp, Homo sapiens
cagtgctcttgtagt

SEQ ID NO: 10354 - DNA, 15 bp, Homo sapiens
agtgctcttgtagtc

SEQ ID NO: 10355 - DNA, 15 bp, Homo sapiens
gtgctcttgtagtcc

SEQ ID NO: 10356 - DNA, 15 bp, Homo sapiens
tgctcttgtagtccc

SEQ ID NO: 10357 - DNA, 15 bp, Homo sapiens
gctcttgtagtccca

SEQ ID NO: 10358 - DNA, 15 bp, Homo sapiens
ctcttgtagtcccaa

SEQ ID NO: 10359 - DNA, 15 bp, Homo sapiens
tcttgtagtcccaag

SEQ ID NO: 10360 - DNA, 15 bp, Homo sapiens
cttgtagtcccaagt

SEQ ID NO: 10361 - DNA, 15 bp, Homo sapiens
ttgtagtcccaagtc

SEQ ID NO: 10362 - DNA, 15 bp, Homo sapiens
tgtagtcccaagtct

SEQ ID NO: 10363 - DNA, 15 bp, Homo sapiens
gtagtcccaagtcta

SEQ ID NO: 10364 - DNA, 15 bp, Homo sapiens
tagtcccaagtctaa

SEQ ID NO: 10365 - DNA, 15 bp, Homo sapiens
agtcccaagtctaag

SEQ ID NO: 10366 - DNA, 15 bp, Homo sapiens
gtcccaagtctaagc

SEQ ID NO: 10367 - DNA, 15 bp, Homo sapiens
tcccaagtctaagct

SEQ ID NO: 10368 - DNA, 15 bp, Homo sapiens
cccaagtctaagctc

SEQ ID NO: 10369 - DNA, 15 bp, Homo sapiens
ccaagtctaagctct

SEQ ID NO: 10370 - DNA, 15 bp, Homo sapiens
caagtctaagctcta

SEQ ID NO: 10371 - DNA, 15 bp, Homo sapiens
aagtctaagctctag

SEQ ID NO: 10372 - DNA, 15 bp, Homo sapiens
agtctaagctctagg

SEQ ID NO: 10373 - DNA, 15 bp, Homo sapiens
gtctaagctctaggt

SEQ ID NO: 10374 - DNA, 15 bp, Homo sapiens
tctaagctctaggtt

SEQ ID NO: 10375 - DNA, 15 bp, Homo sapiens
ctaagctctaggttg

SEQ ID NO: 10376 - DNA, 15 bp, Homo sapiens
taagctctaggttgc

SEQ ID NO: 10377 - DNA, 15 bp, Homo sapiens
aagctctaggttgcc

SEQ ID NO: 10378 - DNA, 15 bp, Homo sapiens
agctctaggttgcct

SEQ ID NO: 10379 - DNA, 15 bp, Homo sapiens
gctctaggttgcctt

SEQ ID NO: 10380 - DNA, 15 bp, Homo sapiens
ctctaggttgccttc

SEQ ID NO: 10381 - DNA, 15 bp, Homo sapiens
tctaggttgccttct

SEQ ID NO: 10382 - DNA, 15 bp, Homo sapiens
ctaggttgccttctt

SEQ ID NO: 10383 - DNA, 15 bp, Homo sapiens
taggttgccttcttt

SEQ ID NO: 10384 - DNA, 15 bp, Homo sapiens
aggttgccttctttc

SEQ ID NO: 10385 - DNA, 15 bp, Homo sapiens
ggttgccttctttcc

SEQ ID NO: 10386 - DNA, 15 bp, Homo sapiens
gttgccttctttcct

SEQ ID NO: 10387 - DNA, 15 bp, Homo sapiens
ttgccttctttcctg

SEQ ID NO: 10388 - DNA, 15 bp, Homo sapiens
tgccttctttcctgg

SEQ ID NO: 10389 - DNA, 15 bp, Homo sapiens
gccttctttcctggc

SEQ ID NO: 10390 - DNA, 15 bp, Homo sapiens
ccttctttcctggca

SEQ ID NO: 10391 - DNA, 15 bp, Homo sapiens
cttctttcctggcag

SEQ ID NO: 10392 - DNA, 15 bp, Homo sapiens
ttctttcctggcaga

SEQ ID NO: 10393 - DNA, 15 bp, Homo sapiens
tctttcctggcagaa

SEQ ID NO: 10394 - DNA, 15 bp, Homo sapiens
ctttcctggcagaag

SEQ ID NO: 10395 - DNA, 15 bp, Homo sapiens
tttcctggcagaagt

SEQ ID NO: 10396 - DNA, 15 bp, Homo sapiens
ttcctggcagaagtt

SEQ ID NO: 10397 - DNA, 15 bp, Homo sapiens
tcctggcagaagttg

SEQ ID NO: 10398 - DNA, 15 bp, Homo sapiens
cctggcagaagttgg

SEQ ID NO: 10399 - DNA, 15 bp, Homo sapiens
ctggcagaagttggt

SEQ ID NO: 10400 - DNA, 15 bp, Homo sapiens
tggcagaagttggtg

SEQ ID NO: 10401 - DNA, 15 bp, Homo sapiens
ggcagaagttggtgt

SEQ ID NO: 10402 - DNA, 15 bp, Homo sapiens
gcagaagttggtgtc

SEQ ID NO: 10403 - DNA, 15 bp, Homo sapiens
cagaagttggtgtct

SEQ ID NO: 10404 - DNA, 15 bp, Homo sapiens
agaagttggtgtcta

SEQ ID NO: 10405 - DNA, 15 bp, Homo sapiens
gaagttggtgtctat

SEQ ID NO: 10406 - DNA, 15 bp, Homo sapiens
aagttggtgtctatg

SEQ ID NO: 10407 - DNA, 15 bp, Homo sapiens
agttggtgtctatgc

SEQ ID NO: 10408 - DNA, 15 bp, Homo sapiens
gttggtgtctatgcc

SEQ ID NO: 10409 - DNA, 15 bp, Homo sapiens
ttggtgtctatgcca

SEQ ID NO: 10410 - DNA, 15 bp, Homo sapiens
tggtgtctatgccat

SEQ ID NO: 10411 - DNA, 15 bp, Homo sapiens
ggtgtctatgccata

SEQ ID NO: 10412 - DNA, 15 bp, Homo sapiens
gtgtctatgccataa

SEQ ID NO: 10413 - DNA, 15 bp, Homo sapiens
tgtctatgccataag

SEQ ID NO: 10414 - DNA, 15 bp, Homo sapiens
gtctatgccataagg

SEQ ID NO: 10415 - DNA, 15 bp, Homo sapiens
tctatgccataagga

SEQ ID NO: 10416 - DNA, 15 bp, Homo sapiens
ctatgccataaggag

SEQ ID NO: 10417 - DNA, 15 bp, Homo sapiens
tatgccataaggagg

SEQ ID NO: 10418 - DNA, 15 bp, Homo sapiens
atgccataaggaggt

SEQ ID NO: 10419 - DNA, 15 bp, Homo sapiens
tgccataaggaggta

SEQ ID NO: 10420 - DNA, 15 bp, Homo sapiens
gccataaggaggtag

SEQ ID NO: 10421 - DNA, 15 bp, Homo sapiens
ccataaggaggtagt

SEQ ID NO: 10422 - DNA, 15 bp, Homo sapiens
cataaggaggtagtt

SEQ ID NO: 10423 - DNA, 15 bp, Homo sapiens
ataaggaggtagttc

SEQ ID NO: 10424 - DNA, 15 bp, Homo sapiens
taaggaggtagttcc

SEQ ID NO: 10425 - DNA, 15 bp, Homo sapiens
aaggaggtagttcct

SEQ ID NO: 10426 - DNA, 15 bp, Homo sapiens
aggaggtagttcctg

SEQ ID NO: 10427 - DNA, 15 bp, Homo sapiens
ggaggtagttcctgt

SEQ ID NO: 10428 - DNA, 15 bp, Homo sapiens
gaggtagttcctgtt

SEQ ID NO: 10429 - DNA, 15 bp, Homo sapiens
aggtagttcctgtta

SEQ ID NO: 10430 - DNA, 15 bp, Homo sapiens
ggtagttcctgttag

SEQ ID NO: 10431 - DNA, 15 bp, Homo sapiens
gtagttcctgttaga

SEQ ID NO: 10432 - DNA, 15 bp, Homo sapiens
tagttcctgttagaa

SEQ ID NO: 10433 - DNA, 15 bp, Homo sapiens
agttcctgttagaag

SEQ ID NO: 10434 - DNA, 15 bp, Homo sapiens
gttcctgttagaagg

SEQ ID NO: 10435 - DNA, 15 bp, Homo sapiens
ttcctgttagaaggg

SEQ ID NO: 10436 - DNA, 15 bp, Homo sapiens
tcctgttagaaggga

SEQ ID NO: 10437 - DNA, 15 bp, Homo sapiens
cctgttagaagggat

SEQ ID NO: 10438 - DNA, 15 bp, Homo sapiens
ctgttagaagggatt

SEQ ID NO: 10439 - DNA, 15 bp, Homo sapiens
tgttagaagggattt

SEQ ID NO: 10440 - DNA, 15 bp, Homo sapiens
gttagaagggattta

SEQ ID NO: 10441 - DNA, 15 bp, Homo sapiens
ttagaagggatttaa

SEQ ID NO: 10442 - DNA, 15 bp, Homo sapiens
tagaagggatttaat

SEQ ID NO: 10443 - DNA, 15 bp, Homo sapiens
agaagggatttaatt

SEQ ID NO: 10444 - DNA, 15 bp, Homo sapiens
gaagggatttaatta

SEQ ID NO: 10445 - DNA, 15 bp, Homo sapiens
aagggatttaattat

SEQ ID NO: 10446 - DNA, 15 bp, Homo sapiens
agggatttaattata

SEQ ID NO: 10447 - DNA, 15 bp, Homo sapiens
gggatttaattatac

SEQ ID NO: 10448 - DNA, 15 bp, Homo sapiens
ggatttaattatacc

SEQ ID NO: 10449 - DNA, 15 bp, Homo sapiens
gatttaattatacct

SEQ ID NO: 10450 - DNA, 15 bp, Homo sapiens
atttaattatacctt

SEQ ID NO: 10451 - DNA, 15 bp, Homo sapiens
tttaattatacctta

SEQ ID NO: 10452 - DNA, 15 bp, Homo sapiens
ttaattataccttat

SEQ ID NO: 10453 - DNA, 15 bp, Homo sapiens
taattataccttata

SEQ ID NO: 10454 - DNA, 15 bp, Homo sapiens
aattataccttatat

SEQ ID NO: 10455 - DNA, 15 bp, Homo sapiens
attataccttatata

SEQ ID NO: 10456 - DNA, 15 bp, Homo sapiens
ttataccttatataa

SEQ ID NO: 10457 - DNA, 15 bp, Homo sapiens
tataccttatataag

SEQ ID NO: 10458 - DNA, 15 bp, Homo sapiens
ataccttatataagg

SEQ ID NO: 10459 - DNA, 15 bp, Homo sapiens
taccttatataagga

SEQ ID NO: 10460 - DNA, 15 bp, Homo sapiens
accttatataaggaa

SEQ ID NO: 10461 - DNA, 15 bp, Homo sapiens
ccttatataaggaat

SEQ ID NO: 10462 - DNA, 15 bp, Homo sapiens
cttatataaggaatt

SEQ ID NO: 10463 - DNA, 15 bp, Homo sapiens
ttatataaggaatta

SEQ ID NO: 10464 - DNA, 15 bp, Homo sapiens
tatataaggaattag

SEQ ID NO: 10465 - DNA, 15 bp, Homo sapiens
atataaggaattagt

SEQ ID NO: 10466 - DNA, 15 bp, Homo sapiens
tataaggaattagtg

SEQ ID NO: 10467 - DNA, 15 bp, Homo sapiens
ataaggaattagtgt

SEQ ID NO: 10468 - DNA, 15 bp, Homo sapiens
taaggaattagtgtt

SEQ ID NO: 10469 - DNA, 15 bp, Homo sapiens
aaggaattagtgttt

SEQ ID NO: 10470 - DNA, 15 bp, Homo sapiens
aggaattagtgtttg

SEQ ID NO: 10471 - DNA, 15 bp, Homo sapiens
ggaattagtgtttgc

SEQ ID NO: 10472 - DNA, 15 bp, Homo sapiens
gaattagtgtttgcc

SEQ ID NO: 10473 - DNA, 15 bp, Homo sapiens
aattagtgtttgccc

SEQ ID NO: 10474 - DNA, 15 bp, Homo sapiens
attagtgtttgccct

SEQ ID NO: 10475 - DNA, 15 bp, Homo sapiens
ttagtgtttgccctt

SEQ ID NO: 10476 - DNA, 15 bp, Homo sapiens
tagtgtttgcccttc

SEQ ID NO: 10477 - DNA, 15 bp, Homo sapiens
agtgtttgcccttct

SEQ ID NO: 10478 - DNA, 15 bp, Homo sapiens
gtgtttgcccttcta

SEQ ID NO: 10479 - DNA, 15 bp, Homo sapiens
tgtttgcccttctag

SEQ ID NO: 10480 - DNA, 15 bp, Homo sapiens
gtttgcccttctagg

SEQ ID NO: 10481 - DNA, 15 bp, Homo sapiens
tttgcccttctaggt

SEQ ID NO: 10482 - DNA, 15 bp, Homo sapiens
ttgcccttctaggta

SEQ ID NO: 10483 - DNA, 15 bp, Homo sapiens
tgcccttctaggtat

SEQ ID NO: 10484 - DNA, 15 bp, Homo sapiens
gcccttctaggtata

SEQ ID NO: 10485 - DNA, 15 bp, Homo sapiens
cccttctaggtatag

SEQ ID NO: 10486 - DNA, 15 bp, Homo sapiens
ccttctaggtatagt

SEQ ID NO: 10487 - DNA, 15 bp, Homo sapiens
cttctaggtatagtt

SEQ ID NO: 10488 - DNA, 15 bp, Homo sapiens
ttctaggtatagttg

SEQ ID NO: 10489 - DNA, 15 bp, Homo sapiens
tctaggtatagttgg

SEQ ID NO: 10490 - DNA, 15 bp, Homo sapiens
ctaggtatagttgga

SEQ ID NO: 10491 - DNA, 15 bp, Homo sapiens
taggtatagttggat

SEQ ID NO: 10492 - DNA, 15 bp, Homo sapiens
aggtatagttggatg

SEQ ID NO: 10493 - DNA, 15 bp, Homo sapiens
ggtatagttggatgt

SEQ ID NO: 10494 - DNA, 15 bp, Homo sapiens
gtatagttggatgtt

SEQ ID NO: 10495 - DNA, 15 bp, Homo sapiens
tatagttggatgtta

SEQ ID NO: 10496 - DNA, 15 bp, Homo sapiens
atagttggatgttag

SEQ ID NO: 10497 - DNA, 15 bp, Homo sapiens
tagttggatgttagc

SEQ ID NO: 10498 - DNA, 15 bp, Homo sapiens
agttggatgttagct

SEQ ID NO: 10499 - DNA, 15 bp, Homo sapiens
gttggatgttagctt

SEQ ID NO: 10500 - DNA, 15 bp, Homo sapiens
ttggatgttagcttc

SEQ ID NO: 10501 - DNA, 15 bp, Homo sapiens
tggatgttagcttct

SEQ ID NO: 10502 - DNA, 15 bp, Homo sapiens
ggatgttagcttctg

SEQ ID NO: 10503 - DNA, 15 bp, Homo sapiens
gatgttagcttctga

SEQ ID NO: 10504 - DNA, 15 bp, Homo sapiens
atgttagcttctgat

SEQ ID NO: 10505 - DNA, 15 bp, Homo sapiens
tgttagcttctgatg

SEQ ID NO: 10506 - DNA, 15 bp, Homo sapiens
gttagcttctgatgt

SEQ ID NO: 10507 - DNA, 15 bp, Homo sapiens
ttagcttctgatgta

SEQ ID NO: 10508 - DNA, 15 bp, Homo sapiens
tagcttctgatgtaa

SEQ ID NO: 10509 - DNA, 15 bp, Homo sapiens
agcttctgatgtaaa

SEQ ID NO: 10510 - DNA, 15 bp, Homo sapiens
gcttctgatgtaaac

SEQ ID NO: 10511 - DNA, 15 bp, Homo sapiens
cttctgatgtaaact

SEQ ID NO: 10512 - DNA, 15 bp, Homo sapiens
ttctgatgtaaactg

SEQ ID NO: 10513 - DNA, 15 bp, Homo sapiens
tctgatgtaaactgg

SEQ ID NO: 10514 - DNA, 15 bp, Homo sapiens
ctgatgtaaactgga

SEQ ID NO: 10515 - DNA, 15 bp, Homo sapiens
tgatgtaaactggat

SEQ ID NO: 10516 - DNA, 15 bp, Homo sapiens
gatgtaaactggatt

SEQ ID NO: 10517 - DNA, 15 bp, Homo sapiens
atgtaaactggattt

SEQ ID NO: 10518 - DNA, 15 bp, Homo sapiens
tgtaaactggatttc

SEQ ID NO: 10519 - DNA, 15 bp, Homo sapiens
gtaaactggatttct

SEQ ID NO: 10520 - DNA, 15 bp, Homo sapiens
taaactggatttctt

SEQ ID NO: 10521 - DNA, 15 bp, Homo sapiens
aaactggatttcttt

SEQ ID NO: 10522 - DNA, 15 bp, Homo sapiens
aactggatttctttt

SEQ ID NO: 10523 - DNA, 15 bp, Homo sapiens
actggatttcttttt

SEQ ID NO: 10524 - DNA, 15 bp, Homo sapiens
ctggatttctttttc

SEQ ID NO: 10525 - DNA, 15 bp, Homo sapiens
tggatttctttttct

SEQ ID NO: 10526 - DNA, 15 bp, Homo sapiens
ggatttctttttctt

SEQ ID NO: 10527 - DNA, 15 bp, Homo sapiens
gatttctttttcttt

SEQ ID NO: 10528 - DNA, 15 bp, Homo sapiens
atttctttttctttc

SEQ ID NO: 10529 - DNA, 15 bp, Homo sapiens
tttctttttctttct

SEQ ID NO: 10530 - DNA, 15 bp, Homo sapiens
ttctttttctttctc

SEQ ID NO: 10531 - DNA, 15 bp, Homo sapiens
tctttttctttctct

SEQ ID NO: 10532 - DNA, 15 bp, Homo sapiens
ctttttctttctctc

SEQ ID NO: 10533 - DNA, 15 bp, Homo sapiens
tttttctttctctct

SEQ ID NO: 10534 - DNA, 15 bp, Homo sapiens
ttttctttctctctc

SEQ ID NO: 10535 - DNA, 15 bp, Homo sapiens
tttctttctctctct

SEQ ID NO: 10536 - DNA, 15 bp, Homo sapiens
ttctttctctctctt

SEQ ID NO: 10537 - DNA, 15 bp, Homo sapiens
tctttctctctcttt

SEQ ID NO: 10538 - DNA, 15 bp, Homo sapiens
ctttctctctctttt

SEQ ID NO: 10539 - DNA, 15 bp, Homo sapiens
tttctctctcttttt

SEQ ID NO: 10540 - DNA, 15 bp, Homo sapiens
ttctctctctttttt

SEQ ID NO: 10541 - DNA, 15 bp, Homo sapiens
tctctctcttttttt

SEQ ID NO: 10542 - DNA, 15 bp, Homo sapiens
ctctctctttttttt

SEQ ID NO: 10543 - DNA, 15 bp, Homo sapiens
ctttttttttttttg

SEQ ID NO: 10544 - DNA, 15 bp, Homo sapiens
tttttttttgttttg

SEQ ID NO: 10545 - DNA, 15 bp, Homo sapiens
ttttttttgttttgg

SEQ ID NO: 10546 - DNA, 15 bp, Homo sapiens
tttttttgttttgga

SEQ ID NO: 10547 - DNA, 15 bp, Homo sapiens
ttttttgttttggag

SEQ ID NO: 10548 - DNA, 15 bp, Homo sapiens
tttttgttttggagg

SEQ ID NO: 10549 - DNA, 15 bp, Homo sapiens
ttttgttttggaggc

SEQ ID NO: 10550 - DNA, 15 bp, Homo sapiens
tttgttttggaggca

SEQ ID NO: 10551 - DNA, 15 bp, Homo sapiens
ttgttttggaggcag

SEQ ID NO: 10552 - DNA, 15 bp, Homo sapiens
tgttttggaggcaga

SEQ ID NO: 10553 - DNA, 15 bp, Homo sapiens
gttttggaggcagag

SEQ ID NO: 10554 - DNA, 15 bp, Homo sapiens
ttttggaggcagagt

SEQ ID NO: 10555 - DNA, 15 bp, Homo sapiens
tttggaggcagagtt

SEQ ID NO: 10556 - DNA, 15 bp, Homo sapiens
ttggaggcagagttt

SEQ ID NO: 10557 - DNA, 15 bp, Homo sapiens
tggaggcagagtttt

SEQ ID NO: 10558 - DNA, 15 bp, Homo sapiens
ggaggcagagttttg

SEQ ID NO: 10559 - DNA, 15 bp, Homo sapiens
gaggcagagttttgc

SEQ ID NO: 10560 - DNA, 15 bp, Homo sapiens
aggcagagttttgcc

SEQ ID NO: 10561 - DNA, 15 bp, Homo sapiens
ggcagagttttgccc

SEQ ID NO: 10562 - DNA, 15 bp, Homo sapiens
gcagagttttgccct

SEQ ID NO: 10563 - DNA, 15 bp, Homo sapiens
cagagttttgccctt

SEQ ID NO: 10564 - DNA, 15 bp, Homo sapiens
agagttttgcccttg

SEQ ID NO: 10565 - DNA, 15 bp, Homo sapiens
gagttttgcccttgt

SEQ ID NO: 10566 - DNA, 15 bp, Homo sapiens
agttttgcccttgta

SEQ ID NO: 10567 - DNA, 15 bp, Homo sapiens
gttttgcccttgtac

SEQ ID NO: 10568 - DNA, 15 bp, Homo sapiens
ttttgcccttgtacc

SEQ ID NO: 10569 - DNA, 15 bp, Homo sapiens
tttgcccttgtaccc

SEQ ID NO: 10570 - DNA, 15 bp, Homo sapiens
ttgcccttgtacccc

SEQ ID NO: 10571 - DNA, 15 bp, Homo sapiens
tgcccttgtacccca

SEQ ID NO: 10572 - DNA, 15 bp, Homo sapiens
gcccttgtaccccag

SEQ ID NO: 10573 - DNA, 15 bp, Homo sapiens
cccttgtaccccagg

SEQ ID NO: 10574 - DNA, 15 bp, Homo sapiens
ccttgtaccccaggc

SEQ ID NO: 10575 - DNA, 15 bp, Homo sapiens
cttgtaccccaggct

SEQ ID NO: 10576 - DNA, 15 bp, Homo sapiens
ttgtaccccaggctg

SEQ ID NO: 10577 - DNA, 15 bp, Homo sapiens
tgtaccccaggctgg

SEQ ID NO: 10578 - DNA, 15 bp, Homo sapiens
gtaccccaggctgga

SEQ ID NO: 10579 - DNA, 15 bp, Homo sapiens
taccccaggctggag

SEQ ID NO: 10580 - DNA, 15 bp, Homo sapiens
accccaggctggagt

SEQ ID NO: 10581 - DNA, 15 bp, Homo sapiens
ccccaggctggagtg

SEQ ID NO: 10582 - DNA, 15 bp, Homo sapiens
ggagtgcagtggtgt

SEQ ID NO: 10583 - DNA, 15 bp, Homo sapiens
gagtgcagtggtgtg

SEQ ID NO: 10584 - DNA, 15 bp, Homo sapiens
agtgcagtggtgtga

SEQ ID NO: 10585 - DNA, 15 bp, Homo sapiens
gtgcagtggtgtgat

SEQ ID NO: 10586 - DNA, 15 bp, Homo sapiens
tgcagtggtgtgatc

SEQ ID NO: 10587 - DNA, 15 bp, Homo sapiens
gcagtggtgtgatct

SEQ ID NO: 10588 - DNA, 15 bp, Homo sapiens
cagtggtgtgatctc

SEQ ID NO: 10589 - DNA, 15 bp, Homo sapiens
agtggtgtgatctca

SEQ ID NO: 10590 - DNA, 15 bp, Homo sapiens
gtggtgtgatctcag

SEQ ID NO: 10591 - DNA, 15 bp, Homo sapiens
tggtgtgatctcagc

SEQ ID NO: 10592 - DNA, 15 bp, Homo sapiens
ggtgtgatctcagct

SEQ ID NO: 10593 - DNA, 15 bp, Homo sapiens
gtgtgatctcagctc

SEQ ID NO: 10594 - DNA, 15 bp, Homo sapiens
tgtgatctcagctca

SEQ ID NO: 10595 - DNA, 15 bp, Homo sapiens
gtgatctcagctcac

SEQ ID NO: 10596 - DNA, 15 bp, Homo sapiens
tgatctcagctcaca

SEQ ID NO: 10597 - DNA, 15 bp, Homo sapiens
gatctcagctcacag

SEQ ID NO: 10598 - DNA, 15 bp, Homo sapiens
atctcagctcacagc

SEQ ID NO: 10599 - DNA, 15 bp, Homo sapiens
tctcagctcacagca

SEQ ID NO: 10600 - DNA, 15 bp, Homo sapiens
ctcagctcacagcaa

SEQ ID NO: 10601 - DNA, 15 bp, Homo sapiens
tcagctcacagcaac

SEQ ID NO: 10602 - DNA, 15 bp, Homo sapiens
cagctcacagcaacc

SEQ ID NO: 10603 - DNA, 15 bp, Homo sapiens
agctcacagcaacct

SEQ ID NO: 10604 - DNA, 15 bp, Homo sapiens
gctcacagcaacctc

SEQ ID NO: 10605 - DNA, 15 bp, Homo sapiens
ctcacagcaacctcc

SEQ ID NO: 10606 - DNA, 15 bp, Homo sapiens
tcacagcaacctccg

SEQ ID NO: 10607 - DNA, 15 bp, Homo sapiens
cacagcaacctccgc

SEQ ID NO: 10608 - DNA, 15 bp, Homo sapiens
acagcaacctccgcc

SEQ ID NO: 10609 - DNA, 15 bp, Homo sapiens
cagcaacctccgcct

SEQ ID NO: 10610 - DNA, 15 bp, Homo sapiens
agcaacctccgcctc

SEQ ID NO: 10611 - DNA, 15 bp, Homo sapiens
caacctccgcctcct

SEQ ID NO: 10612 - DNA, 15 bp, Homo sapiens
aacctccgcctcctg

SEQ ID NO: 10613 - DNA, 15 bp, Homo sapiens
acctccgcctcctgg

SEQ ID NO: 10614 - DNA, 15 bp, Homo sapiens
cctccgcctcctggg

SEQ ID NO: 10615 - DNA, 15 bp, Homo sapiens
ctccgcctcctgggt

SEQ ID NO: 10616 - DNA, 15 bp, Homo sapiens
tccgcctcctgggtt

SEQ ID NO: 10617 - DNA, 15 bp, Homo sapiens
ccgcctcctgggttc

SEQ ID NO: 10618 - DNA, 15 bp, Homo sapiens
cgcctcctgggttca

SEQ ID NO: 10619 - DNA, 15 bp, Homo sapiens
cctgggttcaagcaa

SEQ ID NO: 10620 - DNA, 15 bp, Homo sapiens
ctgggttcaagcaat

SEQ ID NO: 10621 - DNA, 15 bp, Homo sapiens
tgggttcaagcaatt

SEQ ID NO: 10622 - DNA, 15 bp, Homo sapiens
gggttcaagcaattc

SEQ ID NO: 10623 - DNA, 15 bp, Homo sapiens
gttcaagcaattctg

SEQ ID NO: 10624 - DNA, 15 bp, Homo sapiens
ttcaagcaattctgc

SEQ ID NO: 10625 - DNA, 15 bp, Homo sapiens
tcaagcaattctgcc

SEQ ID NO: 10626 - DNA, 15 bp, Homo sapiens
caagcaattctgcct

SEQ ID NO: 10627 - DNA, 15 bp, Homo sapiens
aagcaattctgcctc

SEQ ID NO: 10628 - DNA, 15 bp, Homo sapiens
agcaattctgcctcg

SEQ ID NO: 10629 - DNA, 15 bp, Homo sapiens
gcaattctgcctcgg

SEQ ID NO: 10630 - DNA, 15 bp, Homo sapiens
caattctgcctcggc

SEQ ID NO: 10631 - DNA, 15 bp, Homo sapiens
aattctgcctcggcc

SEQ ID NO: 10632 - DNA, 15 bp, Homo sapiens
attctgcctcggcct

SEQ ID NO: 10633 - DNA, 15 bp, Homo sapiens
ttctgcctcggcctc

SEQ ID NO: 10634 - DNA, 15 bp, Homo sapiens
tctgcctcggcctcc

SEQ ID NO: 10635 - DNA, 15 bp, Homo sapiens
ctgcctcggcctccc

SEQ ID NO: 10636 - DNA, 15 bp, Homo sapiens
tgcctcggcctccca

SEQ ID NO: 10637 - DNA, 15 bp, Homo sapiens
cctcggcctcccaag

SEQ ID NO: 10638 - DNA, 15 bp, Homo sapiens
ctcggcctcccaagt

SEQ ID NO: 10639 - DNA, 15 bp, Homo sapiens
tcggcctcccaagta

SEQ ID NO: 10640 - DNA, 15 bp, Homo sapiens
cggcctcccaagtag

SEQ ID NO: 10641 - DNA, 15 bp, Homo sapiens
ggcctcccaagtagc

SEQ ID NO: 10642 - DNA, 15 bp, Homo sapiens
tgggattacaggcga

SEQ ID NO: 10643 - DNA, 15 bp, Homo sapiens
gggattacaggcgac

SEQ ID NO: 10644 - DNA, 15 bp, Homo sapiens
ggattacaggcgact

SEQ ID NO: 10645 - DNA, 15 bp, Homo sapiens
gattacaggcgactg

SEQ ID NO: 10646 - DNA, 15 bp, Homo sapiens
attacaggcgactgc

SEQ ID NO: 10647 - DNA, 15 bp, Homo sapiens
ttacaggcgactgcc

SEQ ID NO: 10648 - DNA, 15 bp, Homo sapiens
tacaggcgactgcca

SEQ ID NO: 10649 - DNA, 15 bp, Homo sapiens
acaggcgactgccac

SEQ ID NO: 10650 - DNA, 15 bp, Homo sapiens
caggcgactgccacc

SEQ ID NO: 10651 - DNA, 15 bp, Homo sapiens
aggcgactgccacca

SEQ ID NO: 10652 - DNA, 15 bp, Homo sapiens
ggcgactgccaccac

SEQ ID NO: 10653 - DNA, 15 bp, Homo sapiens
gcgactgccaccaca

SEQ ID NO: 10654 - DNA, 15 bp, Homo sapiens
cgactgccaccacac

SEQ ID NO: 10655 - DNA, 15 bp, Homo sapiens
gactgccaccacacc

SEQ ID NO: 10656 - DNA, 15 bp, Homo sapiens
actgccaccacaccc

SEQ ID NO: 10657 - DNA, 15 bp, Homo sapiens
ctgccaccacacccg

SEQ ID NO: 10658 - DNA, 15 bp, Homo sapiens
tgccaccacacccgg

SEQ ID NO: 10659 - DNA, 15 bp, Homo sapiens
cccggctaatttttg

SEQ ID NO: 10660 - DNA, 15 bp, Homo sapiens
cggctaatttttgtt

SEQ ID NO: 10661 - DNA, 15 bp, Homo sapiens
ggctaatttttgttt

SEQ ID NO: 10662 - DNA, 15 bp, Homo sapiens
gctaatttttgtttt

SEQ ID NO: 10663 - DNA, 15 bp, Homo sapiens
ctaatttttgtttta

SEQ ID NO: 10664 - DNA, 15 bp, Homo sapiens
taatttttgttttat

SEQ ID NO: 10665 - DNA, 15 bp, Homo sapiens
aatttttgttttatt

SEQ ID NO: 10666 - DNA, 15 bp, Homo sapiens
atttttgttttatta

SEQ ID NO: 10667 - DNA, 15 bp, Homo sapiens
tttttgttttattag

SEQ ID NO: 10668 - DNA, 15 bp, Homo sapiens
ttttgttttattagt

SEQ ID NO: 10669 - DNA, 15 bp, Homo sapiens
tttgttttattagta

SEQ ID NO: 10670 - DNA, 15 bp, Homo sapiens
ttgttttattagtag

SEQ ID NO: 10671 - DNA, 15 bp, Homo sapiens
tgttttattagtaga

SEQ ID NO: 10672 - DNA, 15 bp, Homo sapiens
gttttattagtagag

SEQ ID NO: 10673 - DNA, 15 bp, Homo sapiens
ttttattagtagaga

SEQ ID NO: 10674 - DNA, 15 bp, Homo sapiens
tttattagtagagat

SEQ ID NO: 10675 - DNA, 15 bp, Homo sapiens
ttattagtagagatg

SEQ ID NO: 10676 - DNA, 15 bp, Homo sapiens
tattagtagagatgg

SEQ ID NO: 10677 - DNA, 15 bp, Homo sapiens
attagtagagatggg

SEQ ID NO: 10678 - DNA, 15 bp, Homo sapiens
accatgttggccaga

SEQ ID NO: 10679 - DNA, 15 bp, Homo sapiens
ccatgttggccagac

SEQ ID NO: 10680 - DNA, 15 bp, Homo sapiens
catgttggccagact

SEQ ID NO: 10681 - DNA, 15 bp, Homo sapiens
atgttggccagactg

SEQ ID NO: 10682 - DNA, 15 bp, Homo sapiens
tgttggccagactga

SEQ ID NO: 10683 - DNA, 15 bp, Homo sapiens
gttggccagactgat

SEQ ID NO: 10684 - DNA, 15 bp, Homo sapiens
ttggccagactgatc

SEQ ID NO: 10685 - DNA, 15 bp, Homo sapiens
tggccagactgatct

SEQ ID NO: 10686 - DNA, 15 bp, Homo sapiens
ggccagactgatctt

SEQ ID NO: 10687 - DNA, 15 bp, Homo sapiens
gccagactgatcttg

SEQ ID NO: 10688 - DNA, 15 bp, Homo sapiens
ccagactgatcttga

SEQ ID NO: 10689 - DNA, 15 bp, Homo sapiens
cagactgatcttgaa

SEQ ID NO: 10690 - DNA, 15 bp, Homo sapiens
agactgatcttgaac

SEQ ID NO: 10691 - DNA, 15 bp, Homo sapiens
gactgatcttgaact

SEQ ID NO: 10692 - DNA, 15 bp, Homo sapiens
actgatcttgaactc

SEQ ID NO: 10693 - DNA, 15 bp, Homo sapiens
ctgatcttgaactcc

SEQ ID NO: 10694 - DNA, 15 bp, Homo sapiens
tgatcttgaactcct

SEQ ID NO: 10695 - DNA, 15 bp, Homo sapiens
gatcttgaactcctg

SEQ ID NO: 10696 - DNA, 15 bp, Homo sapiens
atcttgaactcctga

SEQ ID NO: 10697 - DNA, 15 bp, Homo sapiens
caggtgatccacccg

SEQ ID NO: 10698 - DNA, 15 bp, Homo sapiens
aggtgatccacccgc

SEQ ID NO: 10699 - DNA, 15 bp, Homo sapiens
ggtgatccacccgcc

SEQ ID NO: 10700 - DNA, 15 bp, Homo sapiens
gtgatccacccgcct

SEQ ID NO: 10701 - DNA, 15 bp, Homo sapiens
ttggcctcccaaagc

SEQ ID NO: 10702 - DNA, 15 bp, Homo sapiens
tggcctcccaaagcg

SEQ ID NO: 10703 - DNA, 15 bp, Homo sapiens
cctcccaaagcgctg

SEQ ID NO: 10704 - DNA, 15 bp, Homo sapiens
ctcccaaagcgctgg

SEQ ID NO: 10705 - DNA, 15 bp, Homo sapiens
tcccaaagcgctggg

SEQ ID NO: 10706 - DNA, 15 bp, Homo sapiens
cccaaagcgctggga

SEQ ID NO: 10707 - DNA, 15 bp, Homo sapiens
ccaaagcgctgggat

SEQ ID NO: 10708 - DNA, 15 bp, Homo sapiens
caaagcgctgggatt

SEQ ID NO: 10709 - DNA, 15 bp, Homo sapiens
aaagcgctgggatta

SEQ ID NO: 10710 - DNA, 15 bp, Homo sapiens
aagcgctgggattac

SEQ ID NO: 10711 - DNA, 15 bp, Homo sapiens
agcgctgggattaca

SEQ ID NO: 10712 - DNA, 15 bp, Homo sapiens
gcgctgggattacag

SEQ ID NO: 10713 - DNA, 15 bp, Homo sapiens
cgctgggattacagg

SEQ ID NO: 10714 - DNA, 15 bp, Homo sapiens
tacaggcgtgagctg

SEQ ID NO: 10715 - DNA, 15 bp, Homo sapiens
acaggcgtgagctgc

SEQ ID NO: 10716 - DNA, 15 bp, Homo sapiens
caggcgtgagctgcc

SEQ ID NO: 10717 - DNA, 15 bp, Homo sapiens
aggcgtgagctgccg

SEQ ID NO: 10718 - DNA, 15 bp, Homo sapiens
ggcgtgagctgccgc

SEQ ID NO: 10719 - DNA, 15 bp, Homo sapiens
gcgtgagctgccgca

SEQ ID NO: 10720 - DNA, 15 bp, Homo sapiens
cgtgagctgccgcac

SEQ ID NO: 10721 - DNA, 15 bp, Homo sapiens
gtgagctgccgcacc

SEQ ID NO: 10722 - DNA, 15 bp, Homo sapiens
tgagctgccgcaccc

SEQ ID NO: 10723 - DNA, 15 bp, Homo sapiens
gagctgccgcaccca

SEQ ID NO: 10724 - DNA, 15 bp, Homo sapiens
agctgccgcacccag

SEQ ID NO: 10725 - DNA, 15 bp, Homo sapiens
gctgccgcacccagc

SEQ ID NO: 10726 - DNA, 15 bp, Homo sapiens
ctgccgcacccagct

SEQ ID NO: 10727 - DNA, 15 bp, Homo sapiens
tgccgcacccagctg

SEQ ID NO: 10728 - DNA, 15 bp, Homo sapiens
gccgcacccagctgt

SEQ ID NO: 10729 - DNA, 15 bp, Homo sapiens
ccgcacccagctgta

SEQ ID NO: 10730 - DNA, 15 bp, Homo sapiens
cgcacccagctgtaa

SEQ ID NO: 10731 - DNA, 15 bp, Homo sapiens
gcacccagctgtaaa

SEQ ID NO: 10732 - DNA, 15 bp, Homo sapiens
cacccagctgtaaac

SEQ ID NO: 10733 - DNA, 15 bp, Homo sapiens
acccagctgtaaact

SEQ ID NO: 10734 - DNA, 15 bp, Homo sapiens
cccagctgtaaactg

SEQ ID NO: 10735 - DNA, 15 bp, Homo sapiens
ccagctgtaaactgg

SEQ ID NO: 10736 - DNA, 15 bp, Homo sapiens
cagctgtaaactgga

SEQ ID NO: 10737 - DNA, 15 bp, Homo sapiens
agctgtaaactggat

SEQ ID NO: 10738 - DNA, 15 bp, Homo sapiens
gctgtaaactggatt

SEQ ID NO: 10739 - DNA, 15 bp, Homo sapiens
ctgtaaactggattt

SEQ ID NO: 10740 - DNA, 15 bp, Homo sapiens
taaactggatttcta

SEQ ID NO: 10741 - DNA, 15 bp, Homo sapiens
aaactggatttctaa

SEQ ID NO: 10742 - DNA, 15 bp, Homo sapiens
aactggatttctaat

SEQ ID NO: 10743 - DNA, 15 bp, Homo sapiens
actggatttctaatg

SEQ ID NO: 10744 - DNA, 15 bp, Homo sapiens
ctggatttctaatgg

SEQ ID NO: 10745 - DNA, 15 bp, Homo sapiens
tggatttctaatggt

SEQ ID NO: 10746 - DNA, 15 bp, Homo sapiens
ggatttctaatggta

SEQ ID NO: 10747 - DNA, 15 bp, Homo sapiens
gatttctaatggtag

SEQ ID NO: 10748 - DNA, 15 bp, Homo sapiens
atttctaatggtaga

SEQ ID NO: 10749 - DNA, 15 bp, Homo sapiens
tttctaatggtagat

SEQ ID NO: 10750 - DNA, 15 bp, Homo sapiens
ttctaatggtagatt

SEQ ID NO: 10751 - DNA, 15 bp, Homo sapiens
tctaatggtagattt

SEQ ID NO: 10752 - DNA, 15 bp, Homo sapiens
ctaatggtagatttt

SEQ ID NO: 10753 - DNA, 15 bp, Homo sapiens
taatggtagattttt

SEQ ID NO: 10754 - DNA, 15 bp, Homo sapiens
aatggtagattttta

SEQ ID NO: 10755 - DNA, 15 bp, Homo sapiens
atggtagatttttag

SEQ ID NO: 10756 - DNA, 15 bp, Homo sapiens
tggtagatttttagg

SEQ ID NO: 10757 - DNA, 15 bp, Homo sapiens
ggtagatttttaggt

SEQ ID NO: 10758 - DNA, 15 bp, Homo sapiens
gtagatttttaggta

SEQ ID NO: 10759 - DNA, 15 bp, Homo sapiens
tagatttttaggtat

SEQ ID NO: 10760 - DNA, 15 bp, Homo sapiens
agatttttaggtatt

SEQ ID NO: 10761 - DNA, 15 bp, Homo sapiens
gatttttaggtatta

SEQ ID NO: 10762 - DNA, 15 bp, Homo sapiens
atttttaggtattaa

SEQ ID NO: 10763 - DNA, 15 bp, Homo sapiens
tttttaggtattaac

SEQ ID NO: 10764 - DNA, 15 bp, Homo sapiens
ttttaggtattaaca

SEQ ID NO: 10765 - DNA, 15 bp, Homo sapiens
tttaggtattaacaa

SEQ ID NO: 10766 - DNA, 15 bp, Homo sapiens
ttaggtattaacaat

SEQ ID NO: 10767 - DNA, 15 bp, Homo sapiens
taggtattaacaata

SEQ ID NO: 10768 - DNA, 15 bp, Homo sapiens
aggtattaacaatag

SEQ ID NO: 10769 - DNA, 15 bp, Homo sapiens
ggtattaacaataga

SEQ ID NO: 10770 - DNA, 15 bp, Homo sapiens
gtattaacaatagat

SEQ ID NO: 10771 - DNA, 15 bp, Homo sapiens
tattaacaatagata

SEQ ID NO: 10772 - DNA, 15 bp, Homo sapiens
attaacaatagataa

SEQ ID NO: 10773 - DNA, 15 bp, Homo sapiens
ttaacaatagataaa

SEQ ID NO: 10774 - DNA, 15 bp, Homo sapiens
taacaatagataaaa

SEQ ID NO: 10775 - DNA, 15 bp, Homo sapiens
aacaatagataaaaa

SEQ ID NO: 10776 - DNA, 15 bp, Homo sapiens
acaatagataaaaag

SEQ ID NO: 10777 - DNA, 15 bp, Homo sapiens
caatagataaaaaga

SEQ ID NO: 10778 - DNA, 15 bp, Homo sapiens
aatagataaaaagat

SEQ ID NO: 10779 - DNA, 15 bp, Homo sapiens
atagataaaaagata

SEQ ID NO: 10780 - DNA, 15 bp, Homo sapiens
tagataaaaagatac

SEQ ID NO: 10781 - DNA, 15 bp, Homo sapiens
agataaaaagatact

SEQ ID NO: 10782 - DNA, 15 bp, Homo sapiens
gataaaaagatactt

SEQ ID NO: 10783 - DNA, 15 bp, Homo sapiens
ataaaaagatacttt

SEQ ID NO: 10784 - DNA, 15 bp, Homo sapiens
taaaaagatactttt

SEQ ID NO: 10785 - DNA, 15 bp, Homo sapiens
aaaaagatacttttt

SEQ ID NO: 10786 - DNA, 15 bp, Homo sapiens
aaaagatactttttg

SEQ ID NO: 10787 - DNA, 15 bp, Homo sapiens
aaagatactttttgg

SEQ ID NO: 10788 - DNA, 15 bp, Homo sapiens
aagatactttttggc

SEQ ID NO: 10789 - DNA, 15 bp, Homo sapiens
agatactttttggca

SEQ ID NO: 10790 - DNA, 15 bp, Homo sapiens
gatactttttggcat

SEQ ID NO: 10791 - DNA, 15 bp, Homo sapiens
atactttttggcata

SEQ ID NO: 10792 - DNA, 15 bp, Homo sapiens
tactttttggcatac

SEQ ID NO: 10793 - DNA, 15 bp, Homo sapiens
actttttggcatact

SEQ ID NO: 10794 - DNA, 15 bp, Homo sapiens
ctttttggcatactg

SEQ ID NO: 10795 - DNA, 15 bp, Homo sapiens
tttttggcatactgt

SEQ ID NO: 10796 - DNA, 15 bp, Homo sapiens
ttttggcatactgtg

SEQ ID NO: 10797 - DNA, 15 bp, Homo sapiens
tttggcatactgtgt

SEQ ID NO: 10798 - DNA, 15 bp, Homo sapiens
ttggcatactgtgta

SEQ ID NO: 10799 - DNA, 15 bp, Homo sapiens
tggcatactgtgtat

SEQ ID NO: 10800 - DNA, 15 bp, Homo sapiens
ggcatactgtgtatt

SEQ ID NO: 10801 - DNA, 15 bp, Homo sapiens
gcatactgtgtattg

SEQ ID NO: 10802 - DNA, 15 bp, Homo sapiens
catactgtgtattgg

SEQ ID NO: 10803 - DNA, 15 bp, Homo sapiens
atactgtgtattggg

SEQ ID NO: 10804 - DNA, 15 bp, Homo sapiens
tactgtgtattggga

SEQ ID NO: 10805 - DNA, 15 bp, Homo sapiens
actgtgtattgggat

SEQ ID NO: 10806 - DNA, 15 bp, Homo sapiens
ctgtgtattgggatg

SEQ ID NO: 10807 - DNA, 15 bp, Homo sapiens
tgtgtattgggatgg

SEQ ID NO: 10808 - DNA, 15 bp, Homo sapiens
gtgtattgggatggg

SEQ ID NO: 10809 - DNA, 15 bp, Homo sapiens
tgtattgggatgggg

SEQ ID NO: 10810 - DNA, 15 bp, Homo sapiens
gtattgggatggggt

SEQ ID NO: 10811 - DNA, 15 bp, Homo sapiens
tattgggatggggtt

SEQ ID NO: 10812 - DNA, 15 bp, Homo sapiens
attgggatggggtta

SEQ ID NO: 10813 - DNA, 15 bp, Homo sapiens
ttgggatggggttag

SEQ ID NO: 10814 - DNA, 15 bp, Homo sapiens
tgggatggggttaga

SEQ ID NO: 10815 - DNA, 15 bp, Homo sapiens
gggatggggttagaa

SEQ ID NO: 10816 - DNA, 15 bp, Homo sapiens
ggatggggttagaac

SEQ ID NO: 10817 - DNA, 15 bp, Homo sapiens
gatggggttagaaca

SEQ ID NO: 10818 - DNA, 15 bp, Homo sapiens
atggggttagaacag

SEQ ID NO: 10819 - DNA, 15 bp, Homo sapiens
tggggttagaacagg

SEQ ID NO: 10820 - DNA, 15 bp, Homo sapiens
ggggttagaacaggt

SEQ ID NO: 10821 - DNA, 15 bp, Homo sapiens
gggttagaacaggtg

SEQ ID NO: 10822 - DNA, 15 bp, Homo sapiens
ggttagaacaggtgt

SEQ ID NO: 10823 - DNA, 15 bp, Homo sapiens
gttagaacaggtgtt

SEQ ID NO: 10824 - DNA, 15 bp, Homo sapiens
ttagaacaggtgttc

SEQ ID NO: 10825 - DNA, 15 bp, Homo sapiens
tagaacaggtgttct

SEQ ID NO: 10826 - DNA, 15 bp, Homo sapiens
agaacaggtgttcta

SEQ ID NO: 10827 - DNA, 15 bp, Homo sapiens
gaacaggtgttctac

SEQ ID NO: 10828 - DNA, 15 bp, Homo sapiens
aacaggtgttctacc

SEQ ID NO: 10829 - DNA, 15 bp, Homo sapiens
acaggtgttctaccc

SEQ ID NO: 10830 - DNA, 15 bp, Homo sapiens
caggtgttctaccca

SEQ ID NO: 10831 - DNA, 15 bp, Homo sapiens
aggtgttctacccaa

SEQ ID NO: 10832 - DNA, 15 bp, Homo sapiens
ggtgttctacccaag

SEQ ID NO: 10833 - DNA, 15 bp, Homo sapiens
gtgttctacccaaga

SEQ ID NO: 10834 - DNA, 15 bp, Homo sapiens
tgttctacccaagac

SEQ ID NO: 10835 - DNA, 15 bp, Homo sapiens
gttctacccaagaca

SEQ ID NO: 10836 - DNA, 15 bp, Homo sapiens
ttctacccaagacat

SEQ ID NO: 10837 - DNA, 15 bp, Homo sapiens
tctacccaagacatt

SEQ ID NO: 10838 - DNA, 15 bp, Homo sapiens
ctacccaagacattt

SEQ ID NO: 10839 - DNA, 15 bp, Homo sapiens
tacccaagacattta

SEQ ID NO: 10840 - DNA, 15 bp, Homo sapiens
acccaagacatttac

SEQ ID NO: 10841 - DNA, 15 bp, Homo sapiens
cccaagacatttact

SEQ ID NO: 10842 - DNA, 15 bp, Homo sapiens
ccaagacatttactt

SEQ ID NO: 10843 - DNA, 15 bp, Homo sapiens
caagacatttactta

SEQ ID NO: 10844 - DNA, 15 bp, Homo sapiens
aagacatttacttaa

SEQ ID NO: 10845 - DNA, 15 bp, Homo sapiens
agacatttacttaaa

SEQ ID NO: 10846 - DNA, 15 bp, Homo sapiens
gacatttacttaaaa

SEQ ID NO: 10847 - DNA, 15 bp, Homo sapiens
acatttacttaaaat

SEQ ID NO: 10848 - DNA, 15 bp, Homo sapiens
catttacttaaaatc

SEQ ID NO: 10849 - DNA, 15 bp, Homo sapiens
atttacttaaaatcg

SEQ ID NO: 10850 - DNA, 15 bp, Homo sapiens
tttacttaaaatcgc

SEQ ID NO: 10851 - DNA, 15 bp, Homo sapiens
ttacttaaaatcgcc

SEQ ID NO: 10852 - DNA, 15 bp, Homo sapiens
tacttaaaatcgccc

SEQ ID NO: 10853 - DNA, 15 bp, Homo sapiens
acttaaaatcgccct

SEQ ID NO: 10854 - DNA, 15 bp, Homo sapiens
cttaaaatcgccctc

SEQ ID NO: 10855 - DNA, 15 bp, Homo sapiens
ttaaaatcgccctcg

SEQ ID NO: 10856 - DNA, 15 bp, Homo sapiens
taaaatcgccctcga

SEQ ID NO: 10857 - DNA, 15 bp, Homo sapiens
aaaatcgccctcgaa

SEQ ID NO: 10858 - DNA, 15 bp, Homo sapiens
aaatcgccctcgaaa

SEQ ID NO: 10859 - DNA, 15 bp, Homo sapiens
aatcgccctcgaaat

SEQ ID NO: 10860 - DNA, 15 bp, Homo sapiens
atcgccctcgaaatg

SEQ ID NO: 10861 - DNA, 15 bp, Homo sapiens
tcgccctcgaaatgc

SEQ ID NO: 10862 - DNA, 15 bp, Homo sapiens
cgccctcgaaatgct

SEQ ID NO: 10863 - DNA, 15 bp, Homo sapiens
gccctcgaaatgcta

SEQ ID NO: 10864 - DNA, 15 bp, Homo sapiens
ccctcgaaatgctat

SEQ ID NO: 10865 - DNA, 15 bp, Homo sapiens
cctcgaaatgctatg

SEQ ID NO: 10866 - DNA, 15 bp, Homo sapiens
ctcgaaatgctatgt

SEQ ID NO: 10867 - DNA, 15 bp, Homo sapiens
tcgaaatgctatgtg

SEQ ID NO: 10868 - DNA, 15 bp, Homo sapiens
cgaaatgctatgtga

SEQ ID NO: 10869 - DNA, 15 bp, Homo sapiens
gaaatgctatgtgag

SEQ ID NO: 10870 - DNA, 15 bp, Homo sapiens
aaatgctatgtgagc

SEQ ID NO: 10871 - DNA, 15 bp, Homo sapiens
aatgctatgtgagct

SEQ ID NO: 10872 - DNA, 15 bp, Homo sapiens
atgctatgtgagctg

SEQ ID NO: 10873 - DNA, 15 bp, Homo sapiens
tgctatgtgagctgt

SEQ ID NO: 10874 - DNA, 15 bp, Homo sapiens
gctatgtgagctgtg

SEQ ID NO: 10875 - DNA, 15 bp, Homo sapiens
ctatgtgagctgtgt

SEQ ID NO: 10876 - DNA, 15 bp, Homo sapiens
tatgtgagctgtgtg

SEQ ID NO: 10877 - DNA, 15 bp, Homo sapiens
atgtgagctgtgtgt

SEQ ID NO: 10878 - DNA, 15 bp, Homo sapiens
tgtgagctgtgtgtg

SEQ ID NO: 10879 - DNA, 15 bp, Homo sapiens
gtgagctgtgtgtgt

SEQ ID NO: 10880 - DNA, 15 bp, Homo sapiens
tgagctgtgtgtgtg

SEQ ID NO: 10881 - DNA, 15 bp, Homo sapiens
gagctgtgtgtgtgt

SEQ ID NO: 10882 - DNA, 15 bp, Homo sapiens
agctgtgtgtgtgtg

SEQ ID NO: 10883 - DNA, 15 bp, Homo sapiens
gctgtgtgtgtgtgt

SEQ ID NO: 10884 - DNA, 15 bp, Homo sapiens
ctgtgtgtgtgtgtg

SEQ ID NO: 10885 - DNA, 15 bp, Homo sapiens
tgtgtgtgtgtgtgt

SEQ ID NO: 10886 - DNA, 15 bp, Homo sapiens
gtgtgtgtgtgtgtg

SEQ ID NO: 10887 - DNA, 15 bp, Homo sapiens
gtgtgtgtgtgtgta

SEQ ID NO: 10888 - DNA, 15 bp, Homo sapiens
tgtgtgtgtgtgtat

SEQ ID NO: 10889 - DNA, 15 bp, Homo sapiens
gtgtgtgtgtgtatt

SEQ ID NO: 10890 - DNA, 15 bp, Homo sapiens
tgtgtgtgtgtatta

SEQ ID NO: 10891 - DNA, 15 bp, Homo sapiens
gtgtgtgtgtattaa

SEQ ID NO: 10892 - DNA, 15 bp, Homo sapiens
tgtgtgtgtattaag

SEQ ID NO: 10893 - DNA, 15 bp, Homo sapiens
gtgtgtgtattaagg

SEQ ID NO: 10894 - DNA, 15 bp, Homo sapiens
tgtgtgtattaagga

SEQ ID NO: 10895 - DNA, 15 bp, Homo sapiens
gtgtgtattaaggaa

SEQ ID NO: 10896 - DNA, 15 bp, Homo sapiens
tgtgtattaaggaaa

SEQ ID NO: 10897 - DNA, 15 bp, Homo sapiens
gtgtattaaggaaaa

SEQ ID NO: 10898 - DNA, 15 bp, Homo sapiens
tgtattaaggaaaag

SEQ ID NO: 10899 - DNA, 15 bp, Homo sapiens
gtattaaggaaaagc

SEQ ID NO: 10900 - DNA, 15 bp, Homo sapiens
tattaaggaaaagca

SEQ ID NO: 10901 - DNA, 15 bp, Homo sapiens
attaaggaaaagcat

SEQ ID NO: 10902 - DNA, 15 bp, Homo sapiens
ttaaggaaaagcatg

SEQ ID NO: 10903 - DNA, 15 bp, Homo sapiens
taaggaaaagcatga

SEQ ID NO: 10904 - DNA, 15 bp, Homo sapiens
aaggaaaagcatgaa

SEQ ID NO: 10905 - DNA, 15 bp, Homo sapiens
aggaaaagcatgaaa

SEQ ID NO: 10906 - DNA, 15 bp, Homo sapiens
ggaaaagcatgaaag

SEQ ID NO: 10907 - DNA, 15 bp, Homo sapiens
gaaaagcatgaaagt

SEQ ID NO: 10908 - DNA, 15 bp, Homo sapiens
aaaagcatgaaagta

SEQ ID NO: 10909 - DNA, 15 bp, Homo sapiens
aaagcatgaaagtat

SEQ ID NO: 10910 - DNA, 15 bp, Homo sapiens
aagcatgaaagtatt

SEQ ID NO: 10911 - DNA, 15 bp, Homo sapiens
agcatgaaagtattt

SEQ ID NO: 10912 - DNA, 15 bp, Homo sapiens
gcatgaaagtattta

SEQ ID NO: 10913 - DNA, 15 bp, Homo sapiens
catgaaagtatttat

SEQ ID NO: 10914 - DNA, 15 bp, Homo sapiens
atgaaagtatttatg

SEQ ID NO: 10915 - DNA, 15 bp, Homo sapiens
tgaaagtatttatgc

SEQ ID NO: 10916 - DNA, 15 bp, Homo sapiens
gaaagtatttatgct

SEQ ID NO: 10917 - DNA, 15 bp, Homo sapiens
aaagtatttatgctt

SEQ ID NO: 10918 - DNA, 15 bp, Homo sapiens
aagtatttatgcttg

SEQ ID NO: 10919 - DNA, 15 bp, Homo sapiens
agtatttatgcttga

SEQ ID NO: 10920 - DNA, 15 bp, Homo sapiens
gtatttatgcttgat

SEQ ID NO: 10921 - DNA, 15 bp, Homo sapiens
tatttatgcttgatt

SEQ ID NO: 10922 - DNA, 15 bp, Homo sapiens
atttatgcttgattt

SEQ ID NO: 10923 - DNA, 15 bp, Homo sapiens
tttatgcttgatttt

SEQ ID NO: 10924 - DNA, 15 bp, Homo sapiens
ttatgcttgattttt

SEQ ID NO: 10925 - DNA, 15 bp, Homo sapiens
tatgcttgatttttt

SEQ ID NO: 10926 - DNA, 15 bp, Homo sapiens
atgcttgattttttt

SEQ ID NO: 10927 - DNA, 15 bp, Homo sapiens
tgcttgatttttttt

SEQ ID NO: 10928 - DNA, 15 bp, Homo sapiens
gcttgattttttttt

SEQ ID NO: 10929 - DNA, 15 bp, Homo sapiens
cttgatttttttttt

SEQ ID NO: 10930 - DNA, 15 bp, Homo sapiens
ttgattttttttttt

SEQ ID NO: 10931 - DNA, 15 bp, Homo sapiens
tgatttttttttttt

SEQ ID NO: 10932 - DNA, 15 bp, Homo sapiens
gatttttttttttta

SEQ ID NO: 10933 - DNA, 15 bp, Homo sapiens
attttttttttttac

SEQ ID NO: 10934 - DNA, 15 bp, Homo sapiens
ttttttttttttact

SEQ ID NO: 10935 - DNA, 15 bp, Homo sapiens
tttttttttttactc

SEQ ID NO: 10936 - DNA, 15 bp, Homo sapiens
ttttttttttactca

SEQ ID NO: 10937 - DNA, 15 bp, Homo sapiens
tttttttttactcat

SEQ ID NO: 10938 - DNA, 15 bp, Homo sapiens
ttttttttactcata

SEQ ID NO: 10939 - DNA, 15 bp, Homo sapiens
tttttttactcatag

SEQ ID NO: 10940 - DNA, 15 bp, Homo sapiens
ttttttactcatagc

SEQ ID NO: 10941 - DNA, 15 bp, Homo sapiens
tttttactcatagct

SEQ ID NO: 10942 - DNA, 15 bp, Homo sapiens
ttttactcatagctt

SEQ ID NO: 10943 - DNA, 15 bp, Homo sapiens
tttactcatagcttc

SEQ ID NO: 10944 - DNA, 15 bp, Homo sapiens
ttactcatagcttca

SEQ ID NO: 10945 - DNA, 15 bp, Homo sapiens
tactcatagcttcat

SEQ ID NO: 10946 - DNA, 15 bp, Homo sapiens
actcatagcttcata

SEQ ID NO: 10947 - DNA, 15 bp, Homo sapiens
ctcatagcttcatag

SEQ ID NO: 10948 - DNA, 15 bp, Homo sapiens
tcatagcttcatagt

SEQ ID NO: 10949 - DNA, 15 bp, Homo sapiens
catagcttcatagtg

SEQ ID NO: 10950 - DNA, 15 bp, Homo sapiens
atagcttcatagtgg

SEQ ID NO: 10951 - DNA, 15 bp, Homo sapiens
tagcttcatagtgga

SEQ ID NO: 10952 - DNA, 15 bp, Homo sapiens
agcttcatagtggaa

SEQ ID NO: 10953 - DNA, 15 bp, Homo sapiens
gcttcatagtggaac

SEQ ID NO: 10954 - DNA, 15 bp, Homo sapiens
cttcatagtggaaca

SEQ ID NO: 10955 - DNA, 15 bp, Homo sapiens
ttcatagtggaacag

SEQ ID NO: 10956 - DNA, 15 bp, Homo sapiens
tcatagtggaacaga

SEQ ID NO: 10957 - DNA, 15 bp, Homo sapiens
catagtggaacagat

SEQ ID NO: 10958 - DNA, 15 bp, Homo sapiens
atagtggaacagata

SEQ ID NO: 10959 - DNA, 15 bp, Homo sapiens
tagtggaacagatac

SEQ ID NO: 10960 - DNA, 15 bp, Homo sapiens
agtggaacagataca

SEQ ID NO: 10961 - DNA, 15 bp, Homo sapiens
gtggaacagatacat

SEQ ID NO: 10962 - DNA, 15 bp, Homo sapiens
tggaacagatacata

SEQ ID NO: 10963 - DNA, 15 bp, Homo sapiens
ggaacagatacatag

SEQ ID NO: 10964 - DNA, 15 bp, Homo sapiens
gaacagatacatagt

SEQ ID NO: 10965 - DNA, 15 bp, Homo sapiens
aacagatacatagtc

SEQ ID NO: 10966 - DNA, 15 bp, Homo sapiens
acagatacatagtct

SEQ ID NO: 10967 - DNA, 15 bp, Homo sapiens
cagatacatagtcta

SEQ ID NO: 10968 - DNA, 15 bp, Homo sapiens
agatacatagtctaa

SEQ ID NO: 10969 - DNA, 15 bp, Homo sapiens
gatacatagtctaaa

SEQ ID NO: 10970 - DNA, 15 bp, Homo sapiens
atacatagtctaaat

SEQ ID NO: 10971 - DNA, 15 bp, Homo sapiens
tacatagtctaaatc

SEQ ID NO: 10972 - DNA, 15 bp, Homo sapiens
acatagtctaaatca

SEQ ID NO: 10973 - DNA, 15 bp, Homo sapiens
catagtctaaatcaa

SEQ ID NO: 10974 - DNA, 15 bp, Homo sapiens
atagtctaaatcaaa

SEQ ID NO: 10975 - DNA, 15 bp, Homo sapiens
tagtctaaatcaaaa

SEQ ID NO: 10976 - DNA, 15 bp, Homo sapiens
agtctaaatcaaaat

SEQ ID NO: 10977 - DNA, 15 bp, Homo sapiens
gtctaaatcaaaatg

SEQ ID NO: 10978 - DNA, 15 bp, Homo sapiens
tctaaatcaaaatgt

SEQ ID NO: 10979 - DNA, 15 bp, Homo sapiens
ctaaatcaaaatgtt

SEQ ID NO: 10980 - DNA, 15 bp, Homo sapiens
taaatcaaaatgttt

SEQ ID NO: 10981 - DNA, 15 bp, Homo sapiens
aaatcaaaatgttta

SEQ ID NO: 10982 - DNA, 15 bp, Homo sapiens
aatcaaaatgtttaa

SEQ ID NO: 10983 - DNA, 15 bp, Homo sapiens
atcaaaatgtttaaa

SEQ ID NO: 10984 - DNA, 15 bp, Homo sapiens
tcaaaatgtttaaac

SEQ ID NO: 10985 - DNA, 15 bp, Homo sapiens
caaaatgtttaaact

SEQ ID NO: 10986 - DNA, 15 bp, Homo sapiens
aaaatgtttaaactt

SEQ ID NO: 10987 - DNA, 15 bp, Homo sapiens
aaatgtttaaacttt

SEQ ID NO: 10988 - DNA, 15 bp, Homo sapiens
aatgtttaaactttt

SEQ ID NO: 10989 - DNA, 15 bp, Homo sapiens
atgtttaaacttttt

SEQ ID NO: 10990 - DNA, 15 bp, Homo sapiens
tgtttaaacttttta

SEQ ID NO: 10991 - DNA, 15 bp, Homo sapiens
gtttaaactttttat

SEQ ID NO: 10992 - DNA, 15 bp, Homo sapiens
tttaaactttttatg

SEQ ID NO: 10993 - DNA, 15 bp, Homo sapiens
ttaaactttttatgt

SEQ ID NO: 10994 - DNA, 15 bp, Homo sapiens
taaactttttatgtc

SEQ ID NO: 10995 - DNA, 15 bp, Homo sapiens
aaactttttatgtca

SEQ ID NO: 10996 - DNA, 15 bp, Homo sapiens
aactttttatgtcac

SEQ ID NO: 10997 - DNA, 15 bp, Homo sapiens
actttttatgtcact

SEQ ID NO: 10998 - DNA, 15 bp, Homo sapiens
ctttttatgtcactt

SEQ ID NO: 10999 - DNA, 15 bp, Homo sapiens
ttttatgtcacttgc

SEQ ID NO: 11000 - DNA, 15 bp, Homo sapiens
tttatgtcacttgct

SEQ ID NO: 11001 - DNA, 15 bp, Homo sapiens
ttatgtcacttgctg

SEQ ID NO: 11002 - DNA, 15 bp, Homo sapiens
tatgtcacttgctgt

SEQ ID NO: 11003 - DNA, 15 bp, Homo sapiens
atgtcacttgctgtc

SEQ ID NO: 11004 - DNA, 15 bp, Homo sapiens
tgtcacttgctgtct

SEQ ID NO: 11005 - DNA, 15 bp, Homo sapiens
gtcacttgctgtctt

SEQ ID NO: 11006 - DNA, 15 bp, Homo sapiens
tcacttgctgtcttt

SEQ ID NO: 11007 - DNA, 15 bp, Homo sapiens
cacttgctgtctttt

SEQ ID NO: 11008 - DNA, 15 bp, Homo sapiens
acttgctgtcttttc

SEQ ID NO: 11009 - DNA, 15 bp, Homo sapiens
cttgctgtcttttcg

SEQ ID NO: 11010 - DNA, 15 bp, Homo sapiens
ttgctgtcttttcgt

SEQ ID NO: 11011 - DNA, 15 bp, Homo sapiens
tgctgtcttttcgtc

SEQ ID NO: 11012 - DNA, 15 bp, Homo sapiens
gctgtcttttcgtcc

SEQ ID NO: 11013 - DNA, 15 bp, Homo sapiens
ctgtcttttcgtcct

SEQ ID NO: 11014 - DNA, 15 bp, Homo sapiens
tgtcttttcgtcctc

SEQ ID NO: 11015 - DNA, 15 bp, Homo sapiens
gtcttttcgtcctcg

SEQ ID NO: 11016 - DNA, 15 bp, Homo sapiens
tcttttcgtcctcgt

SEQ ID NO: 11017 - DNA, 15 bp, Homo sapiens
cttttcgtcctcgtt

SEQ ID NO: 11018 - DNA, 15 bp, Homo sapiens
ttttcgtcctcgtta

SEQ ID NO: 11019 - DNA, 15 bp, Homo sapiens
tttcgtcctcgttaa

SEQ ID NO: 11020 - DNA, 15 bp, Homo sapiens
ttcgtcctcgttaaa

SEQ ID NO: 11021 - DNA, 15 bp, Homo sapiens
tcgtcctcgttaaat

SEQ ID NO: 11022 - DNA, 15 bp, Homo sapiens
cgtcctcgttaaatt

SEQ ID NO: 11023 - DNA, 15 bp, Homo sapiens
gtcctcgttaaattt

SEQ ID NO: 11024 - DNA, 15 bp, Homo sapiens
tcctcgttaaattta

SEQ ID NO: 11025 - DNA, 15 bp, Homo sapiens
cctcgttaaatttaa

SEQ ID NO: 11026 - DNA, 15 bp, Homo sapiens
ctcgttaaatttaat

SEQ ID NO: 11027 - DNA, 15 bp, Homo sapiens
tcgttaaatttaatt

SEQ ID NO: 11028 - DNA, 15 bp, Homo sapiens
cgttaaatttaattt

SEQ ID NO: 11029 - DNA, 15 bp, Homo sapiens
gttaaatttaatttt

SEQ ID NO: 11030 - DNA, 15 bp, Homo sapiens
ttaaatttaattttg

SEQ ID NO: 11031 - DNA, 15 bp, Homo sapiens
taaatttaattttgt

SEQ ID NO: 11032 - DNA, 15 bp, Homo sapiens
aaatttaattttgtt

SEQ ID NO: 11033 - DNA, 15 bp, Homo sapiens
aatttaattttgttg

SEQ ID NO: 11034 - DNA, 15 bp, Homo sapiens
atttaattttgttgg

SEQ ID NO: 11035 - DNA, 15 bp, Homo sapiens
tttaattttgttggt

SEQ ID NO: 11036 - DNA, 15 bp, Homo sapiens
ttaattttgttggtc

SEQ ID NO: 11037 - DNA, 15 bp, Homo sapiens
taattttgttggtct

SEQ ID NO: 11038 - DNA, 15 bp, Homo sapiens
aattttgttggtctt

SEQ ID NO: 11039 - DNA, 15 bp, Homo sapiens
attttgttggtcttt

SEQ ID NO: 11040 - DNA, 15 bp, Homo sapiens
ttttgttggtctttt

SEQ ID NO: 11041 - DNA, 15 bp, Homo sapiens
tttgttggtcttttg

SEQ ID NO: 11042 - DNA, 15 bp, Homo sapiens
ttgttggtcttttgt

SEQ ID NO: 11043 - DNA, 15 bp, Homo sapiens
tgttggtcttttgtt

SEQ ID NO: 11044 - DNA, 15 bp, Homo sapiens
gttggtcttttgttg

SEQ ID NO: 11045 - DNA, 15 bp, Homo sapiens
ttggtcttttgttgt

SEQ ID NO: 11046 - DNA, 15 bp, Homo sapiens
tggtcttttgttgtt

SEQ ID NO: 11047 - DNA, 15 bp, Homo sapiens
ggtcttttgttgtta

SEQ ID NO: 11048 - DNA, 15 bp, Homo sapiens
gtcttttgttgttat

SEQ ID NO: 11049 - DNA, 15 bp, Homo sapiens
tcttttgttgttatt

SEQ ID NO: 11050 - DNA, 15 bp, Homo sapiens
cttttgttgttattg

SEQ ID NO: 11051 - DNA, 15 bp, Homo sapiens
ttttgttgttattgg

SEQ ID NO: 11052 - DNA, 15 bp, Homo sapiens
tttgttgttattggt

SEQ ID NO: 11053 - DNA, 15 bp, Homo sapiens
ttgttgttattggtt

SEQ ID NO: 11054 - DNA, 15 bp, Homo sapiens
tgttgttattggttg

SEQ ID NO: 11055 - DNA, 15 bp, Homo sapiens
gttgttattggttgg

SEQ ID NO: 11056 - DNA, 15 bp, Homo sapiens
ttgttattggttggt

SEQ ID NO: 11057 - DNA, 15 bp, Homo sapiens
tgttattggttggtt

SEQ ID NO: 11058 - DNA, 15 bp, Homo sapiens
gttattggttggttt

SEQ ID NO: 11059 - DNA, 15 bp, Homo sapiens
ttattggttggtttt

SEQ ID NO: 11060 - DNA, 15 bp, Homo sapiens
tattggttggttttc

SEQ ID NO: 11061 - DNA, 15 bp, Homo sapiens
attggttggttttct

SEQ ID NO: 11062 - DNA, 15 bp, Homo sapiens
ttggttggttttctc

SEQ ID NO: 11063 - DNA, 15 bp, Homo sapiens
tggttggttttctcc

SEQ ID NO: 11064 - DNA, 15 bp, Homo sapiens
ggttggttttctcca

SEQ ID NO: 11065 - DNA, 15 bp, Homo sapiens
gttggttttctccaa

SEQ ID NO: 11066 - DNA, 15 bp, Homo sapiens
ttggttttctccaaa

SEQ ID NO: 11067 - DNA, 15 bp, Homo sapiens
tggttttctccaaat

SEQ ID NO: 11068 - DNA, 15 bp, Homo sapiens
ggttttctccaaatg

SEQ ID NO: 11069 - DNA, 15 bp, Homo sapiens
gttttctccaaatgc

SEQ ID NO: 11070 - DNA, 15 bp, Homo sapiens
ttttctccaaatgct

SEQ ID NO: 11071 - DNA, 15 bp, Homo sapiens
tttctccaaatgcta

SEQ ID NO: 11072 - DNA, 15 bp, Homo sapiens
ttctccaaatgctag

SEQ ID NO: 11073 - DNA, 15 bp, Homo sapiens
tctccaaatgctagc

SEQ ID NO: 11074 - DNA, 15 bp, Homo sapiens
ctccaaatgctagct

SEQ ID NO: 11075 - DNA, 15 bp, Homo sapiens
tccaaatgctagcta

SEQ ID NO: 11076 - DNA, 15 bp, Homo sapiens
ccaaatgctagctat

SEQ ID NO: 11077 - DNA, 15 bp, Homo sapiens
caaatgctagctatg

SEQ ID NO: 11078 - DNA, 15 bp, Homo sapiens
aaatgctagctatgt

SEQ ID NO: 11079 - DNA, 15 bp, Homo sapiens
aatgctagctatgtt

SEQ ID NO: 11080 - DNA, 15 bp, Homo sapiens
atgctagctatgtta

SEQ ID NO: 11081 - DNA, 15 bp, Homo sapiens
tgctagctatgttaa

SEQ ID NO: 11082 - DNA, 15 bp, Homo sapiens
gctagctatgttaag

SEQ ID NO: 11083 - DNA, 15 bp, Homo sapiens
ctagctatgttaaga

SEQ ID NO: 11084 - DNA, 15 bp, Homo sapiens
tagctatgttaagaa

SEQ ID NO: 11085 - DNA, 15 bp, Homo sapiens
agctatgttaagaaa

SEQ ID NO: 11086 - DNA, 15 bp, Homo sapiens
gctatgttaagaaat

SEQ ID NO: 11087 - DNA, 15 bp, Homo sapiens
ctatgttaagaaatt

SEQ ID NO: 11088 - DNA, 15 bp, Homo sapiens
tatgttaagaaattt

SEQ ID NO: 11089 - DNA, 15 bp, Homo sapiens
atgttaagaaattta

SEQ ID NO: 11090 - DNA, 15 bp, Homo sapiens
tgttaagaaatttaa

SEQ ID NO: 11091 - DNA, 15 bp, Homo sapiens
gttaagaaatttaag

SEQ ID NO: 11092 - DNA, 15 bp, Homo sapiens
ttaagaaatttaagg

SEQ ID NO: 11093 - DNA, 15 bp, Homo sapiens
taagaaatttaaggc

SEQ ID NO: 11094 - DNA, 15 bp, Homo sapiens
aagaaatttaaggcc

SEQ ID NO: 11095 - DNA, 15 bp, Homo sapiens
agaaatttaaggcca

SEQ ID NO: 11096 - DNA, 15 bp, Homo sapiens
gaaatttaaggccag

SEQ ID NO: 11097 - DNA, 15 bp, Homo sapiens
aaatttaaggccagg

SEQ ID NO: 11098 - DNA, 15 bp, Homo sapiens
aatttaaggccaggt

SEQ ID NO: 11099 - DNA, 15 bp, Homo sapiens
atttaaggccaggta

SEQ ID NO: 11100 - DNA, 15 bp, Homo sapiens
tttaaggccaggtac

SEQ ID NO: 11101 - DNA, 15 bp, Homo sapiens
ttaaggccaggtaca

SEQ ID NO: 11102 - DNA, 15 bp, Homo sapiens
taaggccaggtacag

SEQ ID NO: 11103 - DNA, 15 bp, Homo sapiens
aaggccaggtacagt

SEQ ID NO: 11104 - DNA, 15 bp, Homo sapiens
aggccaggtacagtg

SEQ ID NO: 11105 - DNA, 15 bp, Homo sapiens
ggccaggtacagtgg

SEQ ID NO: 11106 - DNA, 15 bp, Homo sapiens
gccaggtacagtggc

SEQ ID NO: 11107 - DNA, 15 bp, Homo sapiens
ccaggtacagtggct

SEQ ID NO: 11108 - DNA, 15 bp, Homo sapiens
caggtacagtggctc

SEQ ID NO: 11109 - DNA, 15 bp, Homo sapiens
aggtacagtggctca

SEQ ID NO: 11110 - DNA, 15 bp, Homo sapiens
ggtacagtggctcat

SEQ ID NO: 11111 - DNA, 15 bp, Homo sapiens
gtacagtggctcatg

SEQ ID NO: 11112 - DNA, 15 bp, Homo sapiens
tacagtggctcatgc

SEQ ID NO: 11113 - DNA, 15 bp, Homo sapiens
acagtggctcatgcc

SEQ ID NO: 11114 - DNA, 15 bp, Homo sapiens
atgcctgtaatcccg

SEQ ID NO: 11115 - DNA, 15 bp, Homo sapiens
tgcctgtaatcccgg

SEQ ID NO: 11116 - DNA, 15 bp, Homo sapiens
gcctgtaatcccggc

SEQ ID NO: 11117 - DNA, 15 bp, Homo sapiens
cctgtaatcccggca

SEQ ID NO: 11118 - DNA, 15 bp, Homo sapiens
ctgtaatcccggcat

SEQ ID NO: 11119 - DNA, 15 bp, Homo sapiens
tgtaatcccggcatt

SEQ ID NO: 11120 - DNA, 15 bp, Homo sapiens
gtaatcccggcattt

SEQ ID NO: 11121 - DNA, 15 bp, Homo sapiens
taatcccggcatttt

SEQ ID NO: 11122 - DNA, 15 bp, Homo sapiens
aatcccggcatttta

SEQ ID NO: 11123 - DNA, 15 bp, Homo sapiens
atcccggcattttag

SEQ ID NO: 11124 - DNA, 15 bp, Homo sapiens
tcccggcattttaga

SEQ ID NO: 11125 - DNA, 15 bp, Homo sapiens
cccggcattttagaa

SEQ ID NO: 11126 - DNA, 15 bp, Homo sapiens
ccggcattttagaag

SEQ ID NO: 11127 - DNA, 15 bp, Homo sapiens
cggcattttagaagg

SEQ ID NO: 11128 - DNA, 15 bp, Homo sapiens
ggcattttagaaggc

SEQ ID NO: 11129 - DNA, 15 bp, Homo sapiens
gcattttagaaggct

SEQ ID NO: 11130 - DNA, 15 bp, Homo sapiens
cattttagaaggctg

SEQ ID NO: 11131 - DNA, 15 bp, Homo sapiens
attttagaaggctga

SEQ ID NO: 11132 - DNA, 15 bp, Homo sapiens
ttttagaaggctgag

SEQ ID NO: 11133 - DNA, 15 bp, Homo sapiens
tttagaaggctgagg

SEQ ID NO: 11134 - DNA, 15 bp, Homo sapiens
ttagaaggctgaggc

SEQ ID NO: 11135 - DNA, 15 bp, Homo sapiens
tagaaggctgaggca

SEQ ID NO: 11136 - DNA, 15 bp, Homo sapiens
agaaggctgaggcag

SEQ ID NO: 11137 - DNA, 15 bp, Homo sapiens
gaaggctgaggcagg

SEQ ID NO: 11138 - DNA, 15 bp, Homo sapiens
aaggctgaggcagga

SEQ ID NO: 11139 - DNA, 15 bp, Homo sapiens
gaggcaggaggatca

SEQ ID NO: 11140 - DNA, 15 bp, Homo sapiens
aggcaggaggatcac

SEQ ID NO: 11141 - DNA, 15 bp, Homo sapiens
ggcaggaggatcact

SEQ ID NO: 11142 - DNA, 15 bp, Homo sapiens
gcaggaggatcactt

SEQ ID NO: 11143 - DNA, 15 bp, Homo sapiens
caggaggatcacttg

SEQ ID NO: 11144 - DNA, 15 bp, Homo sapiens
aggaggatcacttga

SEQ ID NO: 11145 - DNA, 15 bp, Homo sapiens
aggatcacttgagct

SEQ ID NO: 11146 - DNA, 15 bp, Homo sapiens
ggatcacttgagctc

SEQ ID NO: 11147 - DNA, 15 bp, Homo sapiens
gatcacttgagctca

SEQ ID NO: 11148 - DNA, 15 bp, Homo sapiens
atcacttgagctcag

SEQ ID NO: 11149 - DNA, 15 bp, Homo sapiens
tcacttgagctcagg

SEQ ID NO: 11150 - DNA, 15 bp, Homo sapiens
cacttgagctcagga

SEQ ID NO: 11151 - DNA, 15 bp, Homo sapiens
acttgagctcaggag

SEQ ID NO: 11152 - DNA, 15 bp, Homo sapiens
tgagctcaggagttt

SEQ ID NO: 11153 - DNA, 15 bp, Homo sapiens
gagctcaggagtttg

SEQ ID NO: 11154 - DNA, 15 bp, Homo sapiens
agctcaggagtttga

SEQ ID NO: 11155 - DNA, 15 bp, Homo sapiens
gctcaggagtttgag

SEQ ID NO: 11156 - DNA, 15 bp, Homo sapiens
ctcaggagtttgaga

SEQ ID NO: 11157 - DNA, 15 bp, Homo sapiens
gagtttgagaccagt

SEQ ID NO: 11158 - DNA, 15 bp, Homo sapiens
agtttgagaccagtc

SEQ ID NO: 11159 - DNA, 15 bp, Homo sapiens
gtttgagaccagtct

SEQ ID NO: 11160 - DNA, 15 bp, Homo sapiens
tttgagaccagtctg

SEQ ID NO: 11161 - DNA, 15 bp, Homo sapiens
ttgagaccagtctgg

SEQ ID NO: 11162 - DNA, 15 bp, Homo sapiens
tgagaccagtctggg

SEQ ID NO: 11163 - DNA, 15 bp, Homo sapiens
gagaccagtctgggc

SEQ ID NO: 11164 - DNA, 15 bp, Homo sapiens
agaccagtctgggca

SEQ ID NO: 11165 - DNA, 15 bp, Homo sapiens
gaccagtctgggcaa

SEQ ID NO: 11166 - DNA, 15 bp, Homo sapiens
accagtctgggcaac

SEQ ID NO: 11167 - DNA, 15 bp, Homo sapiens
ccagtctgggcaaca

SEQ ID NO: 11168 - DNA, 15 bp, Homo sapiens
cagtctgggcaacat

SEQ ID NO: 11169 - DNA, 15 bp, Homo sapiens
agtctgggcaacata

SEQ ID NO: 11170 - DNA, 15 bp, Homo sapiens
gtctgggcaacatag

SEQ ID NO: 11171 - DNA, 15 bp, Homo sapiens
tctgggcaacatagc

SEQ ID NO: 11172 - DNA, 15 bp, Homo sapiens
ctgggcaacatagca

SEQ ID NO: 11173 - DNA, 15 bp, Homo sapiens
tgggcaacatagcaa

SEQ ID NO: 11174 - DNA, 15 bp, Homo sapiens
gggcaacatagcaag

SEQ ID NO: 11175 - DNA, 15 bp, Homo sapiens
ggcaacatagcaaga

SEQ ID NO: 11176 - DNA, 15 bp, Homo sapiens
gcaacatagcaagac

SEQ ID NO: 11177 - DNA, 15 bp, Homo sapiens
caacatagcaagacc

SEQ ID NO: 11178 - DNA, 15 bp, Homo sapiens
aacatagcaagacct

SEQ ID NO: 11179 - DNA, 15 bp, Homo sapiens
acatagcaagacctc

SEQ ID NO: 11180 - DNA, 15 bp, Homo sapiens
catagcaagacctcg

SEQ ID NO: 11181 - DNA, 15 bp, Homo sapiens
atagcaagacctcgt

SEQ ID NO: 11182 - DNA, 15 bp, Homo sapiens
tagcaagacctcgtc

SEQ ID NO: 11183 - DNA, 15 bp, Homo sapiens
agcaagacctcgtct

SEQ ID NO: 11184 - DNA, 15 bp, Homo sapiens
gcaagacctcgtctt

SEQ ID NO: 11185 - DNA, 15 bp, Homo sapiens
caagacctcgtcttt

SEQ ID NO: 11186 - DNA, 15 bp, Homo sapiens
aagacctcgtctttg

SEQ ID NO: 11187 - DNA, 15 bp, Homo sapiens
agacctcgtctttgt

SEQ ID NO: 11188 - DNA, 15 bp, Homo sapiens
gacctcgtctttgtt

SEQ ID NO: 11189 - DNA, 15 bp, Homo sapiens
acctcgtctttgttt

SEQ ID NO: 11190 - DNA, 15 bp, Homo sapiens
cctcgtctttgttta

SEQ ID NO: 11191 - DNA, 15 bp, Homo sapiens
ctcgtctttgtttag

SEQ ID NO: 11192 - DNA, 15 bp, Homo sapiens
tcgtctttgtttagg

SEQ ID NO: 11193 - DNA, 15 bp, Homo sapiens
cgtctttgtttaggg

SEQ ID NO: 11194 - DNA, 15 bp, Homo sapiens
gtctttgtttagggg

SEQ ID NO: 11195 - DNA, 15 bp, Homo sapiens
tctttgtttagggga

SEQ ID NO: 11196 - DNA, 15 bp, Homo sapiens
ctttgtttaggggaa

SEQ ID NO: 11197 - DNA, 15 bp, Homo sapiens
tttgtttaggggaaa

SEQ ID NO: 11198 - DNA, 15 bp, Homo sapiens
ttgtttaggggaaaa

SEQ ID NO: 11199 - DNA, 15 bp, Homo sapiens
tgtttaggggaaaaa

SEQ ID NO: 11200 - DNA, 15 bp, Homo sapiens
gtttaggggaaaaaa

SEQ ID NO: 11201 - DNA, 15 bp, Homo sapiens
tttaggggaaaaaaa

SEQ ID NO: 11202 - DNA, 15 bp, Homo sapiens
ttaggggaaaaaaaa

SEQ ID NO: 11203 - DNA, 15 bp, Homo sapiens
taggggaaaaaaaag

SEQ ID NO: 11204 - DNA, 15 bp, Homo sapiens
aggggaaaaaaaaga

SEQ ID NO: 11205 - DNA, 15 bp, Homo sapiens
ggggaaaaaaaagaa

SEQ ID NO: 11206 - DNA, 15 bp, Homo sapiens
gggaaaaaaaagaaa

SEQ ID NO: 11207 - DNA, 15 bp, Homo sapiens
ggaaaaaaaagaaat

SEQ ID NO: 11208 - DNA, 15 bp, Homo sapiens
gaaaaaaaagaaatt

SEQ ID NO: 11209 - DNA, 15 bp, Homo sapiens
aaaaaaaagaaattt

SEQ ID NO: 11210 - DNA, 15 bp, Homo sapiens
aaaaaaagaaattta

SEQ ID NO: 11211 - DNA, 15 bp, Homo sapiens
aaaaaagaaatttaa

SEQ ID NO: 11212 - DNA, 15 bp, Homo sapiens
aaaaagaaatttaag

SEQ ID NO: 11213 - DNA, 15 bp, Homo sapiens
aaaagaaatttaagt

SEQ ID NO: 11214 - DNA, 15 bp, Homo sapiens
aaagaaatttaagta

SEQ ID NO: 11215 - DNA, 15 bp, Homo sapiens
aagaaatttaagtag

SEQ ID NO: 11216 - DNA, 15 bp, Homo sapiens
agaaatttaagtagg

SEQ ID NO: 11217 - DNA, 15 bp, Homo sapiens
gaaatttaagtagga

SEQ ID NO: 11218 - DNA, 15 bp, Homo sapiens
aaatttaagtaggag

SEQ ID NO: 11219 - DNA, 15 bp, Homo sapiens
aatttaagtaggaga

SEQ ID NO: 11220 - DNA, 15 bp, Homo sapiens
atttaagtaggagat

SEQ ID NO: 11221 - DNA, 15 bp, Homo sapiens
tttaagtaggagatt

SEQ ID NO: 11222 - DNA, 15 bp, Homo sapiens
ttaagtaggagatta

SEQ ID NO: 11223 - DNA, 15 bp, Homo sapiens
taagtaggagattat

SEQ ID NO: 11224 - DNA, 15 bp, Homo sapiens
aagtaggagattata

SEQ ID NO: 11225 - DNA, 15 bp, Homo sapiens
agtaggagattatat

SEQ ID NO: 11226 - DNA, 15 bp, Homo sapiens
gtaggagattatata

SEQ ID NO: 11227 - DNA, 15 bp, Homo sapiens
taggagattatataa

SEQ ID NO: 11228 - DNA, 15 bp, Homo sapiens
aggagattatataag

SEQ ID NO: 11229 - DNA, 15 bp, Homo sapiens
ggagattatataagc

SEQ ID NO: 11230 - DNA, 15 bp, Homo sapiens
gagattatataagca

SEQ ID NO: 11231 - DNA, 15 bp, Homo sapiens
agattatataagcaa

SEQ ID NO: 11232 - DNA, 15 bp, Homo sapiens
gattatataagcaaa

SEQ ID NO: 11233 - DNA, 15 bp, Homo sapiens
attatataagcaaaa

SEQ ID NO: 11234 - DNA, 15 bp, Homo sapiens
ttatataagcaaaaa

SEQ ID NO: 11235 - DNA, 15 bp, Homo sapiens
tatataagcaaaaat

SEQ ID NO: 11236 - DNA, 15 bp, Homo sapiens
atataagcaaaaata

SEQ ID NO: 11237 - DNA, 15 bp, Homo sapiens
tataagcaaaaatac

SEQ ID NO: 11238 - DNA, 15 bp, Homo sapiens
ataagcaaaaataca

SEQ ID NO: 11239 - DNA, 15 bp, Homo sapiens
taagcaaaaatacaa

SEQ ID NO: 11240 - DNA, 15 bp, Homo sapiens
aagcaaaaatacaat

SEQ ID NO: 11241 - DNA, 15 bp, Homo sapiens
agcaaaaatacaatt

SEQ ID NO: 11242 - DNA, 15 bp, Homo sapiens
gcaaaaatacaatta

SEQ ID NO: 11243 - DNA, 15 bp, Homo sapiens
caaaaatacaattaa

SEQ ID NO: 11244 - DNA, 15 bp, Homo sapiens
aaaaatacaattaat

SEQ ID NO: 11245 - DNA, 15 bp, Homo sapiens
aaaatacaattaatt

SEQ ID NO: 11246 - DNA, 15 bp, Homo sapiens
aaatacaattaattt

SEQ ID NO: 11247 - DNA, 15 bp, Homo sapiens
aatacaattaatttc

SEQ ID NO: 11248 - DNA, 15 bp, Homo sapiens
atacaattaatttcc

SEQ ID NO: 11249 - DNA, 15 bp, Homo sapiens
tacaattaatttcca

SEQ ID NO: 11250 - DNA, 15 bp, Homo sapiens
acaattaatttccag

SEQ ID NO: 11251 - DNA, 15 bp, Homo sapiens
caattaatttccagc

SEQ ID NO: 11252 - DNA, 15 bp, Homo sapiens
aattaatttccagca

SEQ ID NO: 11253 - DNA, 15 bp, Homo sapiens
attaatttccagcat

SEQ ID NO: 11254 - DNA, 15 bp, Homo sapiens
ttaatttccagcatt

SEQ ID NO: 11255 - DNA, 15 bp, Homo sapiens
taatttccagcattc

SEQ ID NO: 11256 - DNA, 15 bp, Homo sapiens
aatttccagcattca

SEQ ID NO: 11257 - DNA, 15 bp, Homo sapiens
atttccagcattcac

SEQ ID NO: 11258 - DNA, 15 bp, Homo sapiens
tttccagcattcact

SEQ ID NO: 11259 - DNA, 15 bp, Homo sapiens
ttccagcattcacta

SEQ ID NO: 11260 - DNA, 15 bp, Homo sapiens
tccagcattcactat

SEQ ID NO: 11261 - DNA, 15 bp, Homo sapiens
ccagcattcactata

SEQ ID NO: 11262 - DNA, 15 bp, Homo sapiens
cagcattcactatat

SEQ ID NO: 11263 - DNA, 15 bp, Homo sapiens
agcattcactatata

SEQ ID NO: 11264 - DNA, 15 bp, Homo sapiens
gcattcactatataa

SEQ ID NO: 11265 - DNA, 15 bp, Homo sapiens
cattcactatataat

SEQ ID NO: 11266 - DNA, 15 bp, Homo sapiens
attcactatataata

SEQ ID NO: 11267 - DNA, 15 bp, Homo sapiens
ttcactatataatat

SEQ ID NO: 11268 - DNA, 15 bp, Homo sapiens
tcactatataatata

SEQ ID NO: 11269 - DNA, 15 bp, Homo sapiens
cactatataatataa

SEQ ID NO: 11270 - DNA, 15 bp, Homo sapiens
actatataatataaa

SEQ ID NO: 11271 - DNA, 15 bp, Homo sapiens
ctatataatataaat

SEQ ID NO: 11272 - DNA, 15 bp, Homo sapiens
tatataatataaatc

SEQ ID NO: 11273 - DNA, 15 bp, Homo sapiens
atataatataaatct

SEQ ID NO: 11274 - DNA, 15 bp, Homo sapiens
tataatataaatctc

SEQ ID NO: 11275 - DNA, 15 bp, Homo sapiens
ataatataaatctcc

SEQ ID NO: 11276 - DNA, 15 bp, Homo sapiens
taatataaatctcca

SEQ ID NO: 11277 - DNA, 15 bp, Homo sapiens
aatataaatctccag

SEQ ID NO: 11278 - DNA, 15 bp, Homo sapiens
atataaatctccaga

SEQ ID NO: 11279 - DNA, 15 bp, Homo sapiens
tataaatctccagac

SEQ ID NO: 11280 - DNA, 15 bp, Homo sapiens
ataaatctccagact

SEQ ID NO: 11281 - DNA, 15 bp, Homo sapiens
taaatctccagactt

SEQ ID NO: 11282 - DNA, 15 bp, Homo sapiens
aaatctccagacttt

SEQ ID NO: 11283 - DNA, 15 bp, Homo sapiens
aatctccagacttta

SEQ ID NO: 11284 - DNA, 15 bp, Homo sapiens
atctccagactttac

SEQ ID NO: 11285 - DNA, 15 bp, Homo sapiens
tctccagactttact

SEQ ID NO: 11286 - DNA, 15 bp, Homo sapiens
ctccagactttactt

SEQ ID NO: 11287 - DNA, 15 bp, Homo sapiens
tccagactttacttt

SEQ ID NO: 11288 - DNA, 15 bp, Homo sapiens
ccagactttactttt

SEQ ID NO: 11289 - DNA, 15 bp, Homo sapiens
cagactttacttttt

SEQ ID NO: 11290 - DNA, 15 bp, Homo sapiens
agactttactttttt

SEQ ID NO: 11291 - DNA, 15 bp, Homo sapiens
gactttacttttttg

SEQ ID NO: 11292 - DNA, 15 bp, Homo sapiens
actttacttttttgt

SEQ ID NO: 11293 - DNA, 15 bp, Homo sapiens
ctttacttttttgtt

SEQ ID NO: 11294 - DNA, 15 bp, Homo sapiens
tttacttttttgttt

SEQ ID NO: 11295 - DNA, 15 bp, Homo sapiens
ttacttttttgttta

SEQ ID NO: 11296 - DNA, 15 bp, Homo sapiens
tacttttttgtttac

SEQ ID NO: 11297 - DNA, 15 bp, Homo sapiens
acttttttgtttact

SEQ ID NO: 11298 - DNA, 15 bp, Homo sapiens
cttttttgtttactg

SEQ ID NO: 11299 - DNA, 15 bp, Homo sapiens
ttttttgtttactgg

SEQ ID NO: 11300 - DNA, 15 bp, Homo sapiens
tttttgtttactgga

SEQ ID NO: 11301 - DNA, 15 bp, Homo sapiens
ttttgtttactggat

SEQ ID NO: 11302 - DNA, 15 bp, Homo sapiens
tttgtttactggata

SEQ ID NO: 11303 - DNA, 15 bp, Homo sapiens
ttgtttactggatat

SEQ ID NO: 11304 - DNA, 15 bp, Homo sapiens
tgtttactggatata

SEQ ID NO: 11305 - DNA, 15 bp, Homo sapiens
gtttactggatataa

SEQ ID NO: 11306 - DNA, 15 bp, Homo sapiens
tttactggatataaa

SEQ ID NO: 11307 - DNA, 15 bp, Homo sapiens
ttactggatataaac

SEQ ID NO: 11308 - DNA, 15 bp, Homo sapiens
tactggatataaaca

SEQ ID NO: 11309 - DNA, 15 bp, Homo sapiens
actggatataaacaa

SEQ ID NO: 11310 - DNA, 15 bp, Homo sapiens
ctggatataaacaat

SEQ ID NO: 11311 - DNA, 15 bp, Homo sapiens
tggatataaacaata

SEQ ID NO: 11312 - DNA, 15 bp, Homo sapiens
ggatataaacaatat

SEQ ID NO: 11313 - DNA, 15 bp, Homo sapiens
gatataaacaatatc

SEQ ID NO: 11314 - DNA, 15 bp, Homo sapiens
atataaacaatatct

SEQ ID NO: 11315 - DNA, 15 bp, Homo sapiens
tataaacaatatctt

SEQ ID NO: 11316 - DNA, 15 bp, Homo sapiens
ataaacaatatcttt

SEQ ID NO: 11317 - DNA, 15 bp, Homo sapiens
taaacaatatctttt

SEQ ID NO: 11318 - DNA, 15 bp, Homo sapiens
aaacaatatcttttt

SEQ ID NO: 11319 - DNA, 15 bp, Homo sapiens
aacaatatctttttc

SEQ ID NO: 11320 - DNA, 15 bp, Homo sapiens
acaatatctttttct

SEQ ID NO: 11321 - DNA, 15 bp, Homo sapiens
caatatctttttctg

SEQ ID NO: 11322 - DNA, 15 bp, Homo sapiens
aatatctttttctgt

SEQ ID NO: 11323 - DNA, 15 bp, Homo sapiens
atatctttttctgtc

SEQ ID NO: 11324 - DNA, 15 bp, Homo sapiens
tatctttttctgtct

SEQ ID NO: 11325 - DNA, 15 bp, Homo sapiens
atctttttctgtctc

SEQ ID NO: 11326 - DNA, 15 bp, Homo sapiens
tctttttctgtctcc

SEQ ID NO: 11327 - DNA, 15 bp, Homo sapiens
ctttttctgtctcca

SEQ ID NO: 11328 - DNA, 15 bp, Homo sapiens
tttttctgtctccag

SEQ ID NO: 11329 - DNA, 15 bp, Homo sapiens
ttttctgtctccaga

SEQ ID NO: 11330 - DNA, 15 bp, Homo sapiens
tttctgtctccagat

SEQ ID NO: 11331 - DNA, 15 bp, Homo sapiens
ttctgtctccagata

SEQ ID NO: 11332 - DNA, 15 bp, Homo sapiens
tctgtctccagataa

SEQ ID NO: 11333 - DNA, 15 bp, Homo sapiens
ctgtctccagataat

SEQ ID NO: 11334 - DNA, 15 bp, Homo sapiens
tgtctccagataatt

SEQ ID NO: 11335 - DNA, 15 bp, Homo sapiens
gtctccagataattc

SEQ ID NO: 11336 - DNA, 15 bp, Homo sapiens
tctccagataattcc

SEQ ID NO: 11337 - DNA, 15 bp, Homo sapiens
ctccagataattccc

SEQ ID NO: 11338 - DNA, 15 bp, Homo sapiens
tccagataattcccc

SEQ ID NO: 11339 - DNA, 15 bp, Homo sapiens
ccagataattccccc

SEQ ID NO: 11340 - DNA, 15 bp, Homo sapiens
cagataattccccca

SEQ ID NO: 11341 - DNA, 15 bp, Homo sapiens
agataattcccccac

SEQ ID NO: 11342 - DNA, 15 bp, Homo sapiens
gataattcccccacc

SEQ ID NO: 11343 - DNA, 15 bp, Homo sapiens
ataattcccccacca

SEQ ID NO: 11344 - DNA, 15 bp, Homo sapiens
taattcccccaccac

SEQ ID NO: 11345 - DNA, 15 bp, Homo sapiens
aattcccccaccacc

SEQ ID NO: 11346 - DNA, 15 bp, Homo sapiens
attcccccaccacct

SEQ ID NO: 11347 - DNA, 15 bp, Homo sapiens
ttcccccaccacctc

SEQ ID NO: 11348 - DNA, 15 bp, Homo sapiens
tcccccaccacctcc

SEQ ID NO: 11349 - DNA, 15 bp, Homo sapiens
cccccaccacctccc

SEQ ID NO: 11350 - DNA, 15 bp, Homo sapiens
ccccaccacctccca

SEQ ID NO: 11351 - DNA, 15 bp, Homo sapiens
cccaccacctcccat

SEQ ID NO: 11352 - DNA, 15 bp, Homo sapiens
ccaccacctcccata

SEQ ID NO: 11353 - DNA, 15 bp, Homo sapiens
caccacctcccatat

SEQ ID NO: 11354 - DNA, 15 bp, Homo sapiens
accacctcccatatg

SEQ ID NO: 11355 - DNA, 15 bp, Homo sapiens
ccacctcccatatgt

SEQ ID NO: 11356 - DNA, 15 bp, Homo sapiens
cacctcccatatgtc

SEQ ID NO: 11357 - DNA, 15 bp, Homo sapiens
acctcccatatgtcc

SEQ ID NO: 11358 - DNA, 15 bp, Homo sapiens
cctcccatatgtcca

SEQ ID NO: 11359 - DNA, 15 bp, Homo sapiens
ctcccatatgtccag

SEQ ID NO: 11360 - DNA, 15 bp, Homo sapiens
tcccatatgtccaga

SEQ ID NO: 11361 - DNA, 15 bp, Homo sapiens
cccatatgtccagat

SEQ ID NO: 11362 - DNA, 15 bp, Homo sapiens
ccatatgtccagatt

SEQ ID NO: 11363 - DNA, 15 bp, Homo sapiens
catatgtccagattc

SEQ ID NO: 11364 - DNA, 15 bp, Homo sapiens
atatgtccagattct

SEQ ID NO: 11365 - DNA, 15 bp, Homo sapiens
tatgtccagattctc

SEQ ID NO: 11366 - DNA, 15 bp, Homo sapiens
atgtccagattctct

SEQ ID NO: 11367 - DNA, 15 bp, Homo sapiens
tgtccagattctctt

SEQ ID NO: 11368 - DNA, 15 bp, Homo sapiens
gtccagattctcttg

SEQ ID NO: 11369 - DNA, 15 bp, Homo sapiens
tccagattctcttga

SEQ ID NO: 11370 - DNA, 15 bp, Homo sapiens
ccagattctcttgat

SEQ ID NO: 11371 - DNA, 15 bp, Homo sapiens
cagattctcttgatg

SEQ ID NO: 11372 - DNA, 15 bp, Homo sapiens
agattctcttgatga

SEQ ID NO: 11373 - DNA, 15 bp, Homo sapiens
gattctcttgatgat

SEQ ID NO: 11374 - DNA, 15 bp, Homo sapiens
attctcttgatgatg

SEQ ID NO: 11375 - DNA, 15 bp, Homo sapiens
ttctcttgatgatgc

SEQ ID NO: 11376 - DNA, 15 bp, Homo sapiens
tctcttgatgatgct

SEQ ID NO: 11377 - DNA, 15 bp, Homo sapiens
ctcttgatgatgctg

SEQ ID NO: 11378 - DNA, 15 bp, Homo sapiens
tcttgatgatgctga

SEQ ID NO: 11379 - DNA, 15 bp, Homo sapiens
cttgatgatgctgat

SEQ ID NO: 11380 - DNA, 15 bp, Homo sapiens
ttgatgatgctgatg

SEQ ID NO: 11381 - DNA, 15 bp, Homo sapiens
tgatgatgctgatgc

SEQ ID NO: 11382 - DNA, 15 bp, Homo sapiens
gatgatgctgatgct

SEQ ID NO: 11383 - DNA, 15 bp, Homo sapiens
atgatgctgatgctt

SEQ ID NO: 11384 - DNA, 15 bp, Homo sapiens
tgatgctgatgcttt

SEQ ID NO: 11385 - DNA, 15 bp, Homo sapiens
gatgctgatgctttg

SEQ ID NO: 11386 - DNA, 15 bp, Homo sapiens
atgctgatgctttgg

SEQ ID NO: 11387 - DNA, 15 bp, Homo sapiens
tgctgatgctttggg

SEQ ID NO: 11388 - DNA, 15 bp, Homo sapiens
gctgatgctttggga

SEQ ID NO: 11389 - DNA, 15 bp, Homo sapiens
ctgatgctttgggaa

SEQ ID NO: 11390 - DNA, 15 bp, Homo sapiens
tgatgctttgggaag

SEQ ID NO: 11391 - DNA, 15 bp, Homo sapiens
gatgctttgggaagt

SEQ ID NO: 11392 - DNA, 15 bp, Homo sapiens
atgctttgggaagta

SEQ ID NO: 11393 - DNA, 15 bp, Homo sapiens
tgctttgggaagtat

SEQ ID NO: 11394 - DNA, 15 bp, Homo sapiens
gctttgggaagtatg

SEQ ID NO: 11395 - DNA, 15 bp, Homo sapiens
ctttgggaagtatgt

SEQ ID NO: 11396 - DNA, 15 bp, Homo sapiens
tttgggaagtatgtt

SEQ ID NO: 11397 - DNA, 15 bp, Homo sapiens
ttgggaagtatgtta

SEQ ID NO: 11398 - DNA, 15 bp, Homo sapiens
tgggaagtatgttaa

SEQ ID NO: 11399 - DNA, 15 bp, Homo sapiens
gggaagtatgttaat

SEQ ID NO: 11400 - DNA, 15 bp, Homo sapiens
ggaagtatgttaatt

SEQ ID NO: 11401 - DNA, 15 bp, Homo sapiens
gaagtatgttaattt

SEQ ID NO: 11402 - DNA, 15 bp, Homo sapiens
aagtatgttaatttc

SEQ ID NO: 11403 - DNA, 15 bp, Homo sapiens
agtatgttaatttca

SEQ ID NO: 11404 - DNA, 15 bp, Homo sapiens
gtatgttaatttcat

SEQ ID NO: 11405 - DNA, 15 bp, Homo sapiens
tatgttaatttcatg

SEQ ID NO: 11406 - DNA, 15 bp, Homo sapiens
atgttaatttcatgg

SEQ ID NO: 11407 - DNA, 15 bp, Homo sapiens
tgttaatttcatggt

SEQ ID NO: 11408 - DNA, 15 bp, Homo sapiens
gttaatttcatggta

SEQ ID NO: 11409 - DNA, 15 bp, Homo sapiens
ttaatttcatggtac

SEQ ID NO: 11410 - DNA, 15 bp, Homo sapiens
taatttcatggtaca

SEQ ID NO: 11411 - DNA, 15 bp, Homo sapiens
aatttcatggtacat

SEQ ID NO: 11412 - DNA, 15 bp, Homo sapiens
atttcatggtacatg

SEQ ID NO: 11413 - DNA, 15 bp, Homo sapiens
tttcatggtacatga

SEQ ID NO: 11414 - DNA, 15 bp, Homo sapiens
ttcatggtacatgag

SEQ ID NO: 11415 - DNA, 15 bp, Homo sapiens
tcatggtacatgagt

SEQ ID NO: 11416 - DNA, 15 bp, Homo sapiens
catggtacatgagtg

SEQ ID NO: 11417 - DNA, 15 bp, Homo sapiens
atggtacatgagtgg

SEQ ID NO: 11418 - DNA, 15 bp, Homo sapiens
tggtacatgagtggc

SEQ ID NO: 11419 - DNA, 15 bp, Homo sapiens
ggtacatgagtggct

SEQ ID NO: 11420 - DNA, 15 bp, Homo sapiens
gtacatgagtggcta

SEQ ID NO: 11421 - DNA, 15 bp, Homo sapiens
tacatgagtggctat

SEQ ID NO: 11422 - DNA, 15 bp, Homo sapiens
acatgagtggctatc

SEQ ID NO: 11423 - DNA, 15 bp, Homo sapiens
catgagtggctatca

SEQ ID NO: 11424 - DNA, 15 bp, Homo sapiens
atgagtggctatcat

SEQ ID NO: 11425 - DNA, 15 bp, Homo sapiens
tgagtggctatcata

SEQ ID NO: 11426 - DNA, 15 bp, Homo sapiens
gagtggctatcatac

SEQ ID NO: 11427 - DNA, 15 bp, Homo sapiens
agtggctatcatact

SEQ ID NO: 11428 - DNA, 15 bp, Homo sapiens
gtggctatcatactg

SEQ ID NO: 11429 - DNA, 15 bp, Homo sapiens
tggctatcatactgg

SEQ ID NO: 11430 - DNA, 15 bp, Homo sapiens
ggctatcatactggc

SEQ ID NO: 11431 - DNA, 15 bp, Homo sapiens
gctatcatactggct

SEQ ID NO: 11432 - DNA, 15 bp, Homo sapiens
ctatcatactggcta

SEQ ID NO: 11433 - DNA, 15 bp, Homo sapiens
tatcatactggctat

SEQ ID NO: 11434 - DNA, 15 bp, Homo sapiens
atcatactggctatt

SEQ ID NO: 11435 - DNA, 15 bp, Homo sapiens
tcatactggctatta

SEQ ID NO: 11436 - DNA, 15 bp, Homo sapiens
catactggctattat

SEQ ID NO: 11437 - DNA, 15 bp, Homo sapiens
atactggctattata

SEQ ID NO: 11438 - DNA, 15 bp, Homo sapiens
tactggctattatat

SEQ ID NO: 11439 - DNA, 15 bp, Homo sapiens
actggctattatatg

SEQ ID NO: 11440 - DNA, 15 bp, Homo sapiens
ctggctattatatgg

SEQ ID NO: 11441 - DNA, 15 bp, Homo sapiens
tggctattatatggt

SEQ ID NO: 11442 - DNA, 15 bp, Homo sapiens
ggctattatatggta

SEQ ID NO: 11443 - DNA, 15 bp, Homo sapiens
gctattatatggtaa

SEQ ID NO: 11444 - DNA, 15 bp, Homo sapiens
ctattatatggtaag

SEQ ID NO: 11445 - DNA, 15 bp, Homo sapiens
tattatatggtaagt

SEQ ID NO: 11446 - DNA, 15 bp, Homo sapiens
attatatggtaagta

SEQ ID NO: 11447 - DNA, 15 bp, Homo sapiens
ttatatggtaagtaa

SEQ ID NO: 11448 - DNA, 15 bp, Homo sapiens
tatatggtaagtaat

SEQ ID NO: 11449 - DNA, 15 bp, Homo sapiens
atatggtaagtaatc

SEQ ID NO: 11450 - DNA, 15 bp, Homo sapiens
tatggtaagtaatca

SEQ ID NO: 11451 - DNA, 15 bp, Homo sapiens
atggtaagtaatcac

SEQ ID NO: 11452 - DNA, 15 bp, Homo sapiens
tggtaagtaatcact

SEQ ID NO: 11453 - DNA, 15 bp, Homo sapiens
ggtaagtaatcactc

SEQ ID NO: 11454 - DNA, 15 bp, Homo sapiens
gtaagtaatcactca

SEQ ID NO: 11455 - DNA, 15 bp, Homo sapiens
taagtaatcactcag

SEQ ID NO: 11456 - DNA, 15 bp, Homo sapiens
aagtaatcactcagc

SEQ ID NO: 11457 - DNA, 15 bp, Homo sapiens
agtaatcactcagca

SEQ ID NO: 11458 - DNA, 15 bp, Homo sapiens
gtaatcactcagcat

SEQ ID NO: 11459 - DNA, 15 bp, Homo sapiens
taatcactcagcatc

SEQ ID NO: 11460 - DNA, 15 bp, Homo sapiens
aatcactcagcatct

SEQ ID NO: 11461 - DNA, 15 bp, Homo sapiens
atcactcagcatctt

SEQ ID NO: 11462 - DNA, 15 bp, Homo sapiens
tcactcagcatcttt

SEQ ID NO: 11463 - DNA, 15 bp, Homo sapiens
cactcagcatctttt

SEQ ID NO: 11464 - DNA, 15 bp, Homo sapiens
actcagcatcttttc

SEQ ID NO: 11465 - DNA, 15 bp, Homo sapiens
ctcagcatcttttcc

SEQ ID NO: 11466 - DNA, 15 bp, Homo sapiens
tcagcatcttttcct

SEQ ID NO: 11467 - DNA, 15 bp, Homo sapiens
cagcatcttttcctg

SEQ ID NO: 11468 - DNA, 15 bp, Homo sapiens
agcatcttttcctga

SEQ ID NO: 11469 - DNA, 15 bp, Homo sapiens
gcatcttttcctgac

SEQ ID NO: 11470 - DNA, 15 bp, Homo sapiens
catcttttcctgaca

SEQ ID NO: 11471 - DNA, 15 bp, Homo sapiens
atcttttcctgacaa

SEQ ID NO: 11472 - DNA, 15 bp, Homo sapiens
tcttttcctgacaat

SEQ ID NO: 11473 - DNA, 15 bp, Homo sapiens
cttttcctgacaatt

SEQ ID NO: 11474 - DNA, 15 bp, Homo sapiens
ttttcctgacaattt

SEQ ID NO: 11475 - DNA, 15 bp, Homo sapiens
tttcctgacaatttt

SEQ ID NO: 11476 - DNA, 15 bp, Homo sapiens
ttcctgacaattttt

SEQ ID NO: 11477 - DNA, 15 bp, Homo sapiens
tcctgacaatttttt

SEQ ID NO: 11478 - DNA, 15 bp, Homo sapiens
cctgacaattttttt

SEQ ID NO: 11479 - DNA, 15 bp, Homo sapiens
ctgacaatttttttg

SEQ ID NO: 11480 - DNA, 15 bp, Homo sapiens
tgacaatttttttgt

SEQ ID NO: 11481 - DNA, 15 bp, Homo sapiens
gacaatttttttgta

SEQ ID NO: 11482 - DNA, 15 bp, Homo sapiens
acaatttttttgtag

SEQ ID NO: 11483 - DNA, 15 bp, Homo sapiens
caatttttttgtagt

SEQ ID NO: 11484 - DNA, 15 bp, Homo sapiens
aatttttttgtagtt

SEQ ID NO: 11485 - DNA, 15 bp, Homo sapiens
atttttttgtagtta

SEQ ID NO: 11486 - DNA, 15 bp, Homo sapiens
tttttttgtagttat

SEQ ID NO: 11487 - DNA, 15 bp, Homo sapiens
ttttttgtagttatg

SEQ ID NO: 11488 - DNA, 15 bp, Homo sapiens
tttttgtagttatgt

SEQ ID NO: 11489 - DNA, 15 bp, Homo sapiens
ttttgtagttatgtg

SEQ ID NO: 11490 - DNA, 15 bp, Homo sapiens
tttgtagttatgtga

SEQ ID NO: 11491 - DNA, 15 bp, Homo sapiens
ttgtagttatgtgac

SEQ ID NO: 11492 - DNA, 15 bp, Homo sapiens
tgtagttatgtgact

SEQ ID NO: 11493 - DNA, 15 bp, Homo sapiens
gtagttatgtgactt

SEQ ID NO: 11494 - DNA, 15 bp, Homo sapiens
tagttatgtgacttt

SEQ ID NO: 11495 - DNA, 15 bp, Homo sapiens
agttatgtgactttg

SEQ ID NO: 11496 - DNA, 15 bp, Homo sapiens
gttatgtgactttgt

SEQ ID NO: 11497 - DNA, 15 bp, Homo sapiens
ttatgtgactttgtt

SEQ ID NO: 11498 - DNA, 15 bp, Homo sapiens
tatgtgactttgttt

SEQ ID NO: 11499 - DNA, 15 bp, Homo sapiens
atgtgactttgtttt

SEQ ID NO: 11500 - DNA, 15 bp, Homo sapiens
tgtgactttgttttg

SEQ ID NO: 11501 - DNA, 15 bp, Homo sapiens
gtgactttgttttgt

SEQ ID NO: 11502 - DNA, 15 bp, Homo sapiens
tgactttgttttgta

SEQ ID NO: 11503 - DNA, 15 bp, Homo sapiens
gactttgttttgtaa

SEQ ID NO: 11504 - DNA, 15 bp, Homo sapiens
actttgttttgtaaa

SEQ ID NO: 11505 - DNA, 15 bp, Homo sapiens
ctttgttttgtaaat

SEQ ID NO: 11506 - DNA, 15 bp, Homo sapiens
tttgttttgtaaatt

SEQ ID NO: 11507 - DNA, 15 bp, Homo sapiens
ttgttttgtaaattt

SEQ ID NO: 11508 - DNA, 15 bp, Homo sapiens
tgttttgtaaattta

SEQ ID NO: 11509 - DNA, 15 bp, Homo sapiens
gttttgtaaatttat

SEQ ID NO: 11510 - DNA, 15 bp, Homo sapiens
ttttgtaaatttata

SEQ ID NO: 11511 - DNA, 15 bp, Homo sapiens
tttgtaaatttataa

SEQ ID NO: 11512 - DNA, 15 bp, Homo sapiens
ttgtaaatttataaa

SEQ ID NO: 11513 - DNA, 15 bp, Homo sapiens
tgtaaatttataaaa

SEQ ID NO: 11514 - DNA, 15 bp, Homo sapiens
gtaaatttataaaat

SEQ ID NO: 11515 - DNA, 15 bp, Homo sapiens
taaatttataaaata

SEQ ID NO: 11516 - DNA, 15 bp, Homo sapiens
aaatttataaaatac

SEQ ID NO: 11517 - DNA, 15 bp, Homo sapiens
aatttataaaatact

SEQ ID NO: 11518 - DNA, 15 bp, Homo sapiens
atttataaaatacta

SEQ ID NO: 11519 - DNA, 15 bp, Homo sapiens
tttataaaatactac

SEQ ID NO: 11520 - DNA, 15 bp, Homo sapiens
ttataaaatactact

SEQ ID NO: 11521 - DNA, 15 bp, Homo sapiens
tataaaatactactt

SEQ ID NO: 11522 - DNA, 15 bp, Homo sapiens
ataaaatactacttg

SEQ ID NO: 11523 - DNA, 15 bp, Homo sapiens
taaaatactacttgc

SEQ ID NO: 11524 - DNA, 15 bp, Homo sapiens
aaaatactacttgct

SEQ ID NO: 11525 - DNA, 15 bp, Homo sapiens
aaatactacttgctt

SEQ ID NO: 11526 - DNA, 15 bp, Homo sapiens
aatactacttgcttc

SEQ ID NO: 11527 - DNA, 15 bp, Homo sapiens
atactacttgcttct

SEQ ID NO: 11528 - DNA, 15 bp, Homo sapiens
tactacttgcttctc

SEQ ID NO: 11529 - DNA, 15 bp, Homo sapiens
actacttgcttctct

SEQ ID NO: 11530 - DNA, 15 bp, Homo sapiens
ctacttgcttctctc

SEQ ID NO: 11531 - DNA, 15 bp, Homo sapiens
tacttgcttctctct

SEQ ID NO: 11532 - DNA, 15 bp, Homo sapiens
acttgcttctctctt

SEQ ID NO: 11533 - DNA, 15 bp, Homo sapiens
cttgcttctctcttt

SEQ ID NO: 11534 - DNA, 15 bp, Homo sapiens
ttgcttctctcttta

SEQ ID NO: 11535 - DNA, 15 bp, Homo sapiens
tgcttctctctttat

SEQ ID NO: 11536 - DNA, 15 bp, Homo sapiens
gcttctctctttata

SEQ ID NO: 11537 - DNA, 15 bp, Homo sapiens
cttctctctttatat

SEQ ID NO: 11538 - DNA, 15 bp, Homo sapiens
ttctctctttatatt

SEQ ID NO: 11539 - DNA, 15 bp, Homo sapiens
tctctctttatatta

SEQ ID NO: 11540 - DNA, 15 bp, Homo sapiens
ctctctttatattac

SEQ ID NO: 11541 - DNA, 15 bp, Homo sapiens
tctctttatattact

SEQ ID NO: 11542 - DNA, 15 bp, Homo sapiens
ctctttatattacta

SEQ ID NO: 11543 - DNA, 15 bp, Homo sapiens
tctttatattactaa

SEQ ID NO: 11544 - DNA, 15 bp, Homo sapiens
ctttatattactaaa

SEQ ID NO: 11545 - DNA, 15 bp, Homo sapiens
tttatattactaaaa

SEQ ID NO: 11546 - DNA, 15 bp, Homo sapiens
ttatattactaaaaa

SEQ ID NO: 11547 - DNA, 15 bp, Homo sapiens
tatattactaaaaaa

SEQ ID NO: 11548 - DNA, 15 bp, Homo sapiens
atattactaaaaaat

SEQ ID NO: 11549 - DNA, 15 bp, Homo sapiens
tattactaaaaaata

SEQ ID NO: 11550 - DNA, 15 bp, Homo sapiens
attactaaaaaataa

SEQ ID NO: 11551 - DNA, 15 bp, Homo sapiens
ttactaaaaaataaa

SEQ ID NO: 11552 - DNA, 15 bp, Homo sapiens
tactaaaaaataaaa

SEQ ID NO: 11553 - DNA, 15 bp, Homo sapiens
actaaaaaataaaaa

SEQ ID NO: 11554 - DNA, 15 bp, Homo sapiens
ctaaaaaataaaaat

SEQ ID NO: 11555 - DNA, 15 bp, Homo sapiens
taaaaaataaaaata

SEQ ID NO: 11556 - DNA, 15 bp, Homo sapiens
aaaaaataaaaataa

SEQ ID NO: 11557 - DNA, 15 bp, Homo sapiens
aaaaataaaaataaa

SEQ ID NO: 11558 - DNA, 15 bp, Homo sapiens
aaaataaaaataaaa

SEQ ID NO: 11559 - DNA, 15 bp, Homo sapiens
aaataaaaataaaaa

SEQ ID NO: 11560 - DNA, 15 bp, Homo sapiens
aataaaaataaaaaa

SEQ ID NO: 11561 - DNA, 15 bp, Homo sapiens
ataaaaataaaaaaa

SEQ ID NO: 11562 - DNA, 15 bp, Homo sapiens
taaaaataaaaaaat

SEQ ID NO: 11563 - DNA, 15 bp, Homo sapiens
aaaaataaaaaaata

SEQ ID NO: 11564 - DNA, 15 bp, Homo sapiens
aaaataaaaaaatac

SEQ ID NO: 11565 - DNA, 15 bp, Homo sapiens
aaataaaaaaataca

SEQ ID NO: 11566 - DNA, 15 bp, Homo sapiens
aataaaaaaatacaa

SEQ ID NO: 11567 - DNA, 15 bp, Homo sapiens
ataaaaaaatacaac

SEQ ID NO: 11568 - DNA, 15 bp, Homo sapiens
taaaaaaatacaact

SEQ ID NO: 11569 - DNA, 15 bp, Homo sapiens
aaaaaaatacaactg

SEQ ID NO: 11570 - DNA, 15 bp, Homo sapiens
aaaaaatacaactgt

SEQ ID NO: 11571 - DNA, 15 bp, Homo sapiens
aaaaatacaactgtc

SEQ ID NO: 11572 - DNA, 15 bp, Homo sapiens
aaaatacaactgtct

SEQ ID NO: 11573 - DNA, 15 bp, Homo sapiens
aaatacaactgtctg

SEQ ID NO: 11574 - DNA, 15 bp, Homo sapiens
aatacaactgtctga

SEQ ID NO: 11575 - DNA, 15 bp, Homo sapiens
atacaactgtctgag

SEQ ID NO: 11576 - DNA, 15 bp, Homo sapiens
tacaactgtctgagg

SEQ ID NO: 11577 - DNA, 15 bp, Homo sapiens
acaactgtctgaggc

SEQ ID NO: 11578 - DNA, 15 bp, Homo sapiens
caactgtctgaggct

SEQ ID NO: 11579 - DNA, 15 bp, Homo sapiens
aactgtctgaggctt

SEQ ID NO: 11580 - DNA, 15 bp, Homo sapiens
actgtctgaggctta

SEQ ID NO: 11581 - DNA, 15 bp, Homo sapiens
ctgtctgaggcttaa

SEQ ID NO: 11582 - DNA, 15 bp, Homo sapiens
tgtctgaggcttaaa

SEQ ID NO: 11583 - DNA, 15 bp, Homo sapiens
gtctgaggcttaaat

SEQ ID NO: 11584 - DNA, 15 bp, Homo sapiens
tctgaggcttaaatt

SEQ ID NO: 11585 - DNA, 15 bp, Homo sapiens
ctgaggcttaaatta

SEQ ID NO: 11586 - DNA, 15 bp, Homo sapiens
tgaggcttaaattac

SEQ ID NO: 11587 - DNA, 15 bp, Homo sapiens
gaggcttaaattact

SEQ ID NO: 11588 - DNA, 15 bp, Homo sapiens
aggcttaaattactc

SEQ ID NO: 11589 - DNA, 15 bp, Homo sapiens
ggcttaaattactct

SEQ ID NO: 11590 - DNA, 15 bp, Homo sapiens
gcttaaattactctt

SEQ ID NO: 11591 - DNA, 15 bp, Homo sapiens
cttaaattactcttg

SEQ ID NO: 11592 - DNA, 15 bp, Homo sapiens
ttaaattactcttgc

SEQ ID NO: 11593 - DNA, 15 bp, Homo sapiens
taaattactcttgca

SEQ ID NO: 11594 - DNA, 15 bp, Homo sapiens
aaattactcttgcat

SEQ ID NO: 11595 - DNA, 15 bp, Homo sapiens
aattactcttgcatt

SEQ ID NO: 11596 - DNA, 15 bp, Homo sapiens
attactcttgcattg

SEQ ID NO: 11597 - DNA, 15 bp, Homo sapiens
ttactcttgcattgt

SEQ ID NO: 11598 - DNA, 15 bp, Homo sapiens
tactcttgcattgtc

SEQ ID NO: 11599 - DNA, 15 bp, Homo sapiens
actcttgcattgtcc

SEQ ID NO: 11600 - DNA, 15 bp, Homo sapiens
ctcttgcattgtccc

SEQ ID NO: 11601 - DNA, 15 bp, Homo sapiens
tcttgcattgtccct

SEQ ID NO: 11602 - DNA, 15 bp, Homo sapiens
cttgcattgtcccta

SEQ ID NO: 11603 - DNA, 15 bp, Homo sapiens
ttgcattgtccctaa

SEQ ID NO: 11604 - DNA, 15 bp, Homo sapiens
tgcattgtccctaag

SEQ ID NO: 11605 - DNA, 15 bp, Homo sapiens
gcattgtccctaagt

SEQ ID NO: 11606 - DNA, 15 bp, Homo sapiens
cattgtccctaagta

SEQ ID NO: 11607 - DNA, 15 bp, Homo sapiens
attgtccctaagtat

SEQ ID NO: 11608 - DNA, 15 bp, Homo sapiens
ttgtccctaagtata

SEQ ID NO: 11609 - DNA, 15 bp, Homo sapiens
tgtccctaagtataa

SEQ ID NO: 11610 - DNA, 15 bp, Homo sapiens
gtccctaagtataat

SEQ ID NO: 11611 - DNA, 15 bp, Homo sapiens
tccctaagtataatt

SEQ ID NO: 11612 - DNA, 15 bp, Homo sapiens
ccctaagtataattt

SEQ ID NO: 11613 - DNA, 15 bp, Homo sapiens
cctaagtataatttt

SEQ ID NO: 11614 - DNA, 15 bp, Homo sapiens
ctaagtataatttta

SEQ ID NO: 11615 - DNA, 15 bp, Homo sapiens
taagtataattttag

SEQ ID NO: 11616 - DNA, 15 bp, Homo sapiens
aagtataattttagt

SEQ ID NO: 11617 - DNA, 15 bp, Homo sapiens
agtataattttagtt

SEQ ID NO: 11618 - DNA, 15 bp, Homo sapiens
gtataattttagtta

SEQ ID NO: 11619 - DNA, 15 bp, Homo sapiens
tataattttagttaa

SEQ ID NO: 11620 - DNA, 15 bp, Homo sapiens
ataattttagttaat

SEQ ID NO: 11621 - DNA, 15 bp, Homo sapiens
taattttagttaatt

SEQ ID NO: 11622 - DNA, 15 bp, Homo sapiens
aattttagttaattt

SEQ ID NO: 11623 - DNA, 15 bp, Homo sapiens
attttagttaatttt

SEQ ID NO: 11624 - DNA, 15 bp, Homo sapiens
ttttagttaatttta

SEQ ID NO: 11625 - DNA, 15 bp, Homo sapiens
tttagttaattttaa

SEQ ID NO: 11626 - DNA, 15 bp, Homo sapiens
ttagttaattttaaa

SEQ ID NO: 11627 - DNA, 15 bp, Homo sapiens
tagttaattttaaaa

SEQ ID NO: 11628 - DNA, 15 bp, Homo sapiens
agttaattttaaaaa

SEQ ID NO: 11629 - DNA, 15 bp, Homo sapiens
gttaattttaaaaag

SEQ ID NO: 11630 - DNA, 15 bp, Homo sapiens
ttaattttaaaaagc

SEQ ID NO: 11631 - DNA, 15 bp, Homo sapiens
taattttaaaaagct

SEQ ID NO: 11632 - DNA, 15 bp, Homo sapiens
aattttaaaaagctt

SEQ ID NO: 11633 - DNA, 15 bp, Homo sapiens
attttaaaaagcttt

SEQ ID NO: 11634 - DNA, 15 bp, Homo sapiens
ttttaaaaagctttc

SEQ ID NO: 11635 - DNA, 15 bp, Homo sapiens
tttaaaaagctttca

SEQ ID NO: 11636 - DNA, 15 bp, Homo sapiens
ttaaaaagctttcat

SEQ ID NO: 11637 - DNA, 15 bp, Homo sapiens
taaaaagctttcatg

SEQ ID NO: 11638 - DNA, 15 bp, Homo sapiens
aaaaagctttcatgc

SEQ ID NO: 11639 - DNA, 15 bp, Homo sapiens
aaaagctttcatgct

SEQ ID NO: 11640 - DNA, 15 bp, Homo sapiens
aaagctttcatgcta

SEQ ID NO: 11641 - DNA, 15 bp, Homo sapiens
aagctttcatgctat

SEQ ID NO: 11642 - DNA, 15 bp, Homo sapiens
agctttcatgctatt

SEQ ID NO: 11643 - DNA, 15 bp, Homo sapiens
gctttcatgctattg

SEQ ID NO: 11644 - DNA, 15 bp, Homo sapiens
ctttcatgctattgt

SEQ ID NO: 11645 - DNA, 15 bp, Homo sapiens
tttcatgctattgtt

SEQ ID NO: 11646 - DNA, 15 bp, Homo sapiens
ttcatgctattgtta

SEQ ID NO: 11647 - DNA, 15 bp, Homo sapiens
tcatgctattgttag

SEQ ID NO: 11648 - DNA, 15 bp, Homo sapiens
catgctattgttaga

SEQ ID NO: 11649 - DNA, 15 bp, Homo sapiens
atgctattgttagat

SEQ ID NO: 11650 - DNA, 15 bp, Homo sapiens
tgctattgttagatt

SEQ ID NO: 11651 - DNA, 15 bp, Homo sapiens
gctattgttagatta

SEQ ID NO: 11652 - DNA, 15 bp, Homo sapiens
ctattgttagattat

SEQ ID NO: 11653 - DNA, 15 bp, Homo sapiens
tattgttagattatt

SEQ ID NO: 11654 - DNA, 15 bp, Homo sapiens
attgttagattattt

SEQ ID NO: 11655 - DNA, 15 bp, Homo sapiens
ttgttagattatttt

SEQ ID NO: 11656 - DNA, 15 bp, Homo sapiens
tgttagattattttg

SEQ ID NO: 11657 - DNA, 15 bp, Homo sapiens
gttagattattttga

SEQ ID NO: 11658 - DNA, 15 bp, Homo sapiens
ttagattattttgat

SEQ ID NO: 11659 - DNA, 15 bp, Homo sapiens
tagattattttgatt

SEQ ID NO: 11660 - DNA, 15 bp, Homo sapiens
agattattttgatta

SEQ ID NO: 11661 - DNA, 15 bp, Homo sapiens
gattattttgattat

SEQ ID NO: 11662 - DNA, 15 bp, Homo sapiens
attattttgattata

SEQ ID NO: 11663 - DNA, 15 bp, Homo sapiens
ttattttgattatac

SEQ ID NO: 11664 - DNA, 15 bp, Homo sapiens
tattttgattataca

SEQ ID NO: 11665 - DNA, 15 bp, Homo sapiens
attttgattatacac

SEQ ID NO: 11666 - DNA, 15 bp, Homo sapiens
ttttgattatacact

SEQ ID NO: 11667 - DNA, 15 bp, Homo sapiens
tttgattatacactt

SEQ ID NO: 11668 - DNA, 15 bp, Homo sapiens
ttgattatacacttt

SEQ ID NO: 11669 - DNA, 15 bp, Homo sapiens
tgattatacactttt

SEQ ID NO: 11670 - DNA, 15 bp, Homo sapiens
gattatacacttttg

SEQ ID NO: 11671 - DNA, 15 bp, Homo sapiens
attatacacttttga

SEQ ID NO: 11672 - DNA, 15 bp, Homo sapiens
ttatacacttttgaa

SEQ ID NO: 11673 - DNA, 15 bp, Homo sapiens
tatacacttttgaat

SEQ ID NO: 11674 - DNA, 15 bp, Homo sapiens
atacacttttgaatt

SEQ ID NO: 11675 - DNA, 15 bp, Homo sapiens
tacacttttgaattg

SEQ ID NO: 11676 - DNA, 15 bp, Homo sapiens
acacttttgaattga

SEQ ID NO: 11677 - DNA, 15 bp, Homo sapiens
cacttttgaattgaa

SEQ ID NO: 11678 - DNA, 15 bp, Homo sapiens
acttttgaattgaaa

SEQ ID NO: 11679 - DNA, 15 bp, Homo sapiens
cttttgaattgaaat

SEQ ID NO: 11680 - DNA, 15 bp, Homo sapiens
ttttgaattgaaatt

SEQ ID NO: 11681 - DNA, 15 bp, Homo sapiens
tttgaattgaaatta

SEQ ID NO: 11682 - DNA, 15 bp, Homo sapiens
ttgaattgaaattat

SEQ ID NO: 11683 - DNA, 15 bp, Homo sapiens
tgaattgaaattata

SEQ ID NO: 11684 - DNA, 15 bp, Homo sapiens
gaattgaaattatac

SEQ ID NO: 11685 - DNA, 15 bp, Homo sapiens
aattgaaattatact

SEQ ID NO: 11686 - DNA, 15 bp, Homo sapiens
attgaaattatactt

SEQ ID NO: 11687 - DNA, 15 bp, Homo sapiens
ttgaaattatacttt

SEQ ID NO: 11688 - DNA, 15 bp, Homo sapiens
tgaaattatactttt

SEQ ID NO: 11689 - DNA, 15 bp, Homo sapiens
gaaattatacttttt

SEQ ID NO: 11690 - DNA, 15 bp, Homo sapiens
aaattatactttttc

SEQ ID NO: 11691 - DNA, 15 bp, Homo sapiens
aattatactttttct

SEQ ID NO: 11692 - DNA, 15 bp, Homo sapiens
attatactttttcta

SEQ ID NO: 11693 - DNA, 15 bp, Homo sapiens
ttatactttttctaa

SEQ ID NO: 11694 - DNA, 15 bp, Homo sapiens
tatactttttctaaa

SEQ ID NO: 11695 - DNA, 15 bp, Homo sapiens
atactttttctaaat

SEQ ID NO: 11696 - DNA, 15 bp, Homo sapiens
tactttttctaaata

SEQ ID NO: 11697 - DNA, 15 bp, Homo sapiens
actttttctaaataa

SEQ ID NO: 11698 - DNA, 15 bp, Homo sapiens
ctttttctaaataat

SEQ ID NO: 11699 - DNA, 15 bp, Homo sapiens
tttttctaaataatg

SEQ ID NO: 11700 - DNA, 15 bp, Homo sapiens
ttttctaaataatgt

SEQ ID NO: 11701 - DNA, 15 bp, Homo sapiens
tttctaaataatgtt

SEQ ID NO: 11702 - DNA, 15 bp, Homo sapiens
ttctaaataatgttt

SEQ ID NO: 11703 - DNA, 15 bp, Homo sapiens
tctaaataatgtttt

SEQ ID NO: 11704 - DNA, 15 bp, Homo sapiens
ctaaataatgtttta

SEQ ID NO: 11705 - DNA, 15 bp, Homo sapiens
taaataatgttttaa

SEQ ID NO: 11706 - DNA, 15 bp, Homo sapiens
aaataatgttttaat

SEQ ID NO: 11707 - DNA, 15 bp, Homo sapiens
aataatgttttaatc

SEQ ID NO: 11708 - DNA, 15 bp, Homo sapiens
ataatgttttaatct

SEQ ID NO: 11709 - DNA, 15 bp, Homo sapiens
taatgttttaatctc

SEQ ID NO: 11710 - DNA, 15 bp, Homo sapiens
aatgttttaatctct

SEQ ID NO: 11711 - DNA, 15 bp, Homo sapiens
atgttttaatctctg

SEQ ID NO: 11712 - DNA, 15 bp, Homo sapiens
tgttttaatctctga

SEQ ID NO: 11713 - DNA, 15 bp, Homo sapiens
gttttaatctctgat

SEQ ID NO: 11714 - DNA, 15 bp, Homo sapiens
ttttaatctctgatt

SEQ ID NO: 11715 - DNA, 15 bp, Homo sapiens
tttaatctctgattt

SEQ ID NO: 11716 - DNA, 15 bp, Homo sapiens
ttaatctctgatttg

SEQ ID NO: 11717 - DNA, 15 bp, Homo sapiens
taatctctgatttga

SEQ ID NO: 11718 - DNA, 15 bp, Homo sapiens
aatctctgatttgaa

SEQ ID NO: 11719 - DNA, 15 bp, Homo sapiens
atctctgatttgaaa

SEQ ID NO: 11720 - DNA, 15 bp, Homo sapiens
tctctgatttgaaat

SEQ ID NO: 11721 - DNA, 15 bp, Homo sapiens
ctctgatttgaaatt

SEQ ID NO: 11722 - DNA, 15 bp, Homo sapiens
tctgatttgaaattg

SEQ ID NO: 11723 - DNA, 15 bp, Homo sapiens
ctgatttgaaattga

SEQ ID NO: 11724 - DNA, 15 bp, Homo sapiens
tgatttgaaattgat

SEQ ID NO: 11725 - DNA, 15 bp, Homo sapiens
gatttgaaattgatt

SEQ ID NO: 11726 - DNA, 15 bp, Homo sapiens
atttgaaattgattg

SEQ ID NO: 11727 - DNA, 15 bp, Homo sapiens
tttgaaattgattgt

SEQ ID NO: 11728 - DNA, 15 bp, Homo sapiens
ttgaaattgattgta

SEQ ID NO: 11729 - DNA, 15 bp, Homo sapiens
tgaaattgattgtag

SEQ ID NO: 11730 - DNA, 15 bp, Homo sapiens
gaaattgattgtagg

SEQ ID NO: 11731 - DNA, 15 bp, Homo sapiens
aaattgattgtaggg

SEQ ID NO: 11732 - DNA, 15 bp, Homo sapiens
aattgattgtaggga

SEQ ID NO: 11733 - DNA, 15 bp, Homo sapiens
attgattgtagggaa

SEQ ID NO: 11734 - DNA, 15 bp, Homo sapiens
ttgattgtagggaat

SEQ ID NO: 11735 - DNA, 15 bp, Homo sapiens
tgattgtagggaatg

SEQ ID NO: 11736 - DNA, 15 bp, Homo sapiens
gattgtagggaatgg

SEQ ID NO: 11737 - DNA, 15 bp, Homo sapiens
attgtagggaatgga

SEQ ID NO: 11738 - DNA, 15 bp, Homo sapiens
ttgtagggaatggaa

SEQ ID NO: 11739 - DNA, 15 bp, Homo sapiens
tgtagggaatggaaa

SEQ ID NO: 11740 - DNA, 15 bp, Homo sapiens
gtagggaatggaaaa

SEQ ID NO: 11741 - DNA, 15 bp, Homo sapiens
tagggaatggaaaag

SEQ ID NO: 11742 - DNA, 15 bp, Homo sapiens
agggaatggaaaaga

SEQ ID NO: 11743 - DNA, 15 bp, Homo sapiens
gggaatggaaaagat

SEQ ID NO: 11744 - DNA, 15 bp, Homo sapiens
ggaatggaaaagatg

SEQ ID NO: 11745 - DNA, 15 bp, Homo sapiens
gaatggaaaagatgg

SEQ ID NO: 11746 - DNA, 15 bp, Homo sapiens
aatggaaaagatggg

SEQ ID NO: 11747 - DNA, 15 bp, Homo sapiens
atggaaaagatggga

SEQ ID NO: 11748 - DNA, 15 bp, Homo sapiens
tggaaaagatgggat

SEQ ID NO: 11749 - DNA, 15 bp, Homo sapiens
ggaaaagatgggata

SEQ ID NO: 11750 - DNA, 15 bp, Homo sapiens
gaaaagatgggataa

SEQ ID NO: 11751 - DNA, 15 bp, Homo sapiens
aaaagatgggataat

SEQ ID NO: 11752 - DNA, 15 bp, Homo sapiens
aaagatgggataatt

SEQ ID NO: 11753 - DNA, 15 bp, Homo sapiens
aagatgggataattt

SEQ ID NO: 11754 - DNA, 15 bp, Homo sapiens
agatgggataatttt

SEQ ID NO: 11755 - DNA, 15 bp, Homo sapiens
gatgggataattttt

SEQ ID NO: 11756 - DNA, 15 bp, Homo sapiens
atgggataatttttc

SEQ ID NO: 11757 - DNA, 15 bp, Homo sapiens
tgggataatttttca

SEQ ID NO: 11758 - DNA, 15 bp, Homo sapiens
gggataatttttcat

SEQ ID NO: 11759 - DNA, 15 bp, Homo sapiens
ggataatttttcata

SEQ ID NO: 11760 - DNA, 15 bp, Homo sapiens
gataatttttcataa

SEQ ID NO: 11761 - DNA, 15 bp, Homo sapiens
ataatttttcataaa

SEQ ID NO: 11762 - DNA, 15 bp, Homo sapiens
taatttttcataaat

SEQ ID NO: 11763 - DNA, 15 bp, Homo sapiens
aatttttcataaatg

SEQ ID NO: 11764 - DNA, 15 bp, Homo sapiens
atttttcataaatga

SEQ ID NO: 11765 - DNA, 15 bp, Homo sapiens
tttttcataaatgaa

SEQ ID NO: 11766 - DNA, 15 bp, Homo sapiens
ttttcataaatgaaa

SEQ ID NO: 11767 - DNA, 15 bp, Homo sapiens
tttcataaatgaaaa

SEQ ID NO: 11768 - DNA, 15 bp, Homo sapiens
ttcataaatgaaaaa

SEQ ID NO: 11769 - DNA, 15 bp, Homo sapiens
tcataaatgaaaaat

SEQ ID NO: 11770 - DNA, 15 bp, Homo sapiens
cataaatgaaaaatg

SEQ ID NO: 11771 - DNA, 15 bp, Homo sapiens
ataaatgaaaaatga

SEQ ID NO: 11772 - DNA, 15 bp, Homo sapiens
taaatgaaaaatgaa

SEQ ID NO: 11773 - DNA, 15 bp, Homo sapiens
aaatgaaaaatgaaa

SEQ ID NO: 11774 - DNA, 15 bp, Homo sapiens
aatgaaaaatgaaat

SEQ ID NO: 11775 - DNA, 15 bp, Homo sapiens
atgaaaaatgaaatt

SEQ ID NO: 11776 - DNA, 15 bp, Homo sapiens
tgaaaaatgaaattc

SEQ ID NO: 11777 - DNA, 15 bp, Homo sapiens
gaaaaatgaaattct

SEQ ID NO: 11778 - DNA, 15 bp, Homo sapiens
aaaaatgaaattctt

SEQ ID NO: 11779 - DNA, 15 bp, Homo sapiens
aaaatgaaattcttt

SEQ ID NO: 11780 - DNA, 15 bp, Homo sapiens
aaatgaaattctttt

SEQ ID NO: 11781 - DNA, 15 bp, Homo sapiens
aatgaaattcttttt

SEQ ID NO: 11782 - DNA, 15 bp, Homo sapiens
atgaaattctttttt

SEQ ID NO: 11783 - DNA, 15 bp, Homo sapiens
tgaaattcttttttt

SEQ ID NO: 11784 - DNA, 15 bp, Homo sapiens
gaaattctttttttt

SEQ ID NO: 11785 - DNA, 15 bp, Homo sapiens
aaattcttttttttt

SEQ ID NO: 11786 - DNA, 15 bp, Homo sapiens
aattctttttttttt

SEQ ID NO: 11787 - DNA, 15 bp, Homo sapiens
tttttttttgagacg

SEQ ID NO: 11788 - DNA, 15 bp, Homo sapiens
ttttttttgagacgg

SEQ ID NO: 11789 - DNA, 15 bp, Homo sapiens
ttgagacggagtctt

SEQ ID NO: 11790 - DNA, 15 bp, Homo sapiens
tgagacggagtcttg

SEQ ID NO: 11791 - DNA, 15 bp, Homo sapiens
gagacggagtcttgc

SEQ ID NO: 11792 - DNA, 15 bp, Homo sapiens
agacggagtcttgct

SEQ ID NO: 11793 - DNA, 15 bp, Homo sapiens
gacggagtcttgctc

SEQ ID NO: 11794 - DNA, 15 bp, Homo sapiens
acggagtcttgctct

SEQ ID NO: 11795 - DNA, 15 bp, Homo sapiens
cggagtcttgctctg

SEQ ID NO: 11796 - DNA, 15 bp, Homo sapiens
gagtcttgctctgtt

SEQ ID NO: 11797 - DNA, 15 bp, Homo sapiens
agtcttgctctgttg

SEQ ID NO: 11798 - DNA, 15 bp, Homo sapiens
ggagtgcaatggcgt

SEQ ID NO: 11799 - DNA, 15 bp, Homo sapiens
gagtgcaatggcgtg

SEQ ID NO: 11800 - DNA, 15 bp, Homo sapiens
agtgcaatggcgtga

SEQ ID NO: 11801 - DNA, 15 bp, Homo sapiens
gtgcaatggcgtgat

SEQ ID NO: 11802 - DNA, 15 bp, Homo sapiens
tgcaatggcgtgatc

SEQ ID NO: 11803 - DNA, 15 bp, Homo sapiens
gcaatggcgtgatct

SEQ ID NO: 11804 - DNA, 15 bp, Homo sapiens
caatggcgtgatctt

SEQ ID NO: 11805 - DNA, 15 bp, Homo sapiens
aatggcgtgatcttg

SEQ ID NO: 11806 - DNA, 15 bp, Homo sapiens
atggcgtgatcttgg

SEQ ID NO: 11807 - DNA, 15 bp, Homo sapiens
tgatcttggctcaca

SEQ ID NO: 11808 - DNA, 15 bp, Homo sapiens
gatcttggctcacag

SEQ ID NO: 11809 - DNA, 15 bp, Homo sapiens
atcttggctcacagc

SEQ ID NO: 11810 - DNA, 15 bp, Homo sapiens
tcttggctcacagca

SEQ ID NO: 11811 - DNA, 15 bp, Homo sapiens
cttggctcacagcaa

SEQ ID NO: 11812 - DNA, 15 bp, Homo sapiens
ttggctcacagcaag

SEQ ID NO: 11813 - DNA, 15 bp, Homo sapiens
tggctcacagcaagc

SEQ ID NO: 11814 - DNA, 15 bp, Homo sapiens
ggctcacagcaagct

SEQ ID NO: 11815 - DNA, 15 bp, Homo sapiens
gctcacagcaagctc

SEQ ID NO: 11816 - DNA, 15 bp, Homo sapiens
ctcacagcaagctct

SEQ ID NO: 11817 - DNA, 15 bp, Homo sapiens
tcacagcaagctctg

SEQ ID NO: 11818 - DNA, 15 bp, Homo sapiens
cacagcaagctctgc

SEQ ID NO: 11819 - DNA, 15 bp, Homo sapiens
acagcaagctctgcc

SEQ ID NO: 11820 - DNA, 15 bp, Homo sapiens
cagcaagctctgcct

SEQ ID NO: 11821 - DNA, 15 bp, Homo sapiens
agcaagctctgcctt

SEQ ID NO: 11822 - DNA, 15 bp, Homo sapiens
gcaagctctgccttc

SEQ ID NO: 11823 - DNA, 15 bp, Homo sapiens
caagctctgccttct

SEQ ID NO: 11824 - DNA, 15 bp, Homo sapiens
aagctctgccttctg

SEQ ID NO: 11825 - DNA, 15 bp, Homo sapiens
agctctgccttctgg

SEQ ID NO: 11826 - DNA, 15 bp, Homo sapiens
gctctgccttctgga

SEQ ID NO: 11827 - DNA, 15 bp, Homo sapiens
ctctgccttctggat

SEQ ID NO: 11828 - DNA, 15 bp, Homo sapiens
tctgccttctggatt

SEQ ID NO: 11829 - DNA, 15 bp, Homo sapiens
ctgccttctggattc

SEQ ID NO: 11830 - DNA, 15 bp, Homo sapiens
tgccttctggattca

SEQ ID NO: 11831 - DNA, 15 bp, Homo sapiens
gccttctggattcac

SEQ ID NO: 11832 - DNA, 15 bp, Homo sapiens
ccttctggattcacg

SEQ ID NO: 11833 - DNA, 15 bp, Homo sapiens
cttctggattcacgc

SEQ ID NO: 11834 - DNA, 15 bp, Homo sapiens
ttctggattcacgcc

SEQ ID NO: 11835 - DNA, 15 bp, Homo sapiens
tctggattcacgcca

SEQ ID NO: 11836 - DNA, 15 bp, Homo sapiens
ctggattcacgccat

SEQ ID NO: 11837 - DNA, 15 bp, Homo sapiens
tggattcacgccatt

SEQ ID NO: 11838 - DNA, 15 bp, Homo sapiens
ggattcacgccattc

SEQ ID NO: 11839 - DNA, 15 bp, Homo sapiens
gattcacgccattct

SEQ ID NO: 11840 - DNA, 15 bp, Homo sapiens
attcacgccattctc

SEQ ID NO: 11841 - DNA, 15 bp, Homo sapiens
cctgcctcagcctca

SEQ ID NO: 11842 - DNA, 15 bp, Homo sapiens
ctgcctcagcctcag

SEQ ID NO: 11843 - DNA, 15 bp, Homo sapiens
tgcctcagcctcaga

SEQ ID NO: 11844 - DNA, 15 bp, Homo sapiens
gcctcagcctcagag

SEQ ID NO: 11845 - DNA, 15 bp, Homo sapiens
cctcagcctcagagg

SEQ ID NO: 11846 - DNA, 15 bp, Homo sapiens
ctcagcctcagaggt

SEQ ID NO: 11847 - DNA, 15 bp, Homo sapiens
tcagcctcagaggta

SEQ ID NO: 11848 - DNA, 15 bp, Homo sapiens
cagcctcagaggtag

SEQ ID NO: 11849 - DNA, 15 bp, Homo sapiens
agcctcagaggtagc

SEQ ID NO: 11850 - DNA, 15 bp, Homo sapiens
gcctcagaggtagct

SEQ ID NO: 11851 - DNA, 15 bp, Homo sapiens
cctcagaggtagctg

SEQ ID NO: 11852 - DNA, 15 bp, Homo sapiens
ctcagaggtagctgg

SEQ ID NO: 11853 - DNA, 15 bp, Homo sapiens
tcagaggtagctggg

SEQ ID NO: 11854 - DNA, 15 bp, Homo sapiens
cagaggtagctggga

SEQ ID NO: 11855 - DNA, 15 bp, Homo sapiens
agaggtagctgggac

SEQ ID NO: 11856 - DNA, 15 bp, Homo sapiens
gaggtagctgggact

SEQ ID NO: 11857 - DNA, 15 bp, Homo sapiens
ggactacaggtgcct

SEQ ID NO: 11858 - DNA, 15 bp, Homo sapiens
gactacaggtgcctg

SEQ ID NO: 11859 - DNA, 15 bp, Homo sapiens
actacaggtgcctgc

SEQ ID NO: 11860 - DNA, 15 bp, Homo sapiens
ctacaggtgcctgcc

SEQ ID NO: 11861 - DNA, 15 bp, Homo sapiens
tacaggtgcctgcca

SEQ ID NO: 11862 - DNA, 15 bp, Homo sapiens
acaggtgcctgccac

SEQ ID NO: 11863 - DNA, 15 bp, Homo sapiens
caggtgcctgccacc

SEQ ID NO: 11864 - DNA, 15 bp, Homo sapiens
aggtgcctgccacca

SEQ ID NO: 11865 - DNA, 15 bp, Homo sapiens
ggtgcctgccaccac

SEQ ID NO: 11866 - DNA, 15 bp, Homo sapiens
gtgcctgccaccacg

SEQ ID NO: 11867 - DNA, 15 bp, Homo sapiens
tgcctgccaccacgc

SEQ ID NO: 11868 - DNA, 15 bp, Homo sapiens
cctgccaccacgcct

SEQ ID NO: 11869 - DNA, 15 bp, Homo sapiens
ctgccaccacgcctg

SEQ ID NO: 11870 - DNA, 15 bp, Homo sapiens
tgccaccacgcctgt

SEQ ID NO: 11871 - DNA, 15 bp, Homo sapiens
gccaccacgcctgtc

SEQ ID NO: 11872 - DNA, 15 bp, Homo sapiens
ccaccacgcctgtct

SEQ ID NO: 11873 - DNA, 15 bp, Homo sapiens
caccacgcctgtcta

SEQ ID NO: 11874 - DNA, 15 bp, Homo sapiens
accacgcctgtctaa

SEQ ID NO: 11875 - DNA, 15 bp, Homo sapiens
ccacgcctgtctaat

SEQ ID NO: 11876 - DNA, 15 bp, Homo sapiens
cacgcctgtctaatt

SEQ ID NO: 11877 - DNA, 15 bp, Homo sapiens
acgcctgtctaattt

SEQ ID NO: 11878 - DNA, 15 bp, Homo sapiens
cgcctgtctaatttt

SEQ ID NO: 11879 - DNA, 15 bp, Homo sapiens
gcctgtctaattttt

SEQ ID NO: 11880 - DNA, 15 bp, Homo sapiens
cctgtctaatttttt

SEQ ID NO: 11881 - DNA, 15 bp, Homo sapiens
ctgtctaattttttg

SEQ ID NO: 11882 - DNA, 15 bp, Homo sapiens
tgtctaattttttgt

SEQ ID NO: 11883 - DNA, 15 bp, Homo sapiens
gtctaattttttgta

SEQ ID NO: 11884 - DNA, 15 bp, Homo sapiens
tctaattttttgtat

SEQ ID NO: 11885 - DNA, 15 bp, Homo sapiens
taattttttgtattt

SEQ ID NO: 11886 - DNA, 15 bp, Homo sapiens
aattttttgtatttt

SEQ ID NO: 11887 - DNA, 15 bp, Homo sapiens
attttttgtattttt

SEQ ID NO: 11888 - DNA, 15 bp, Homo sapiens
ttttttgtatttttt

SEQ ID NO: 11889 - DNA, 15 bp, Homo sapiens
tttttgtattttttt

SEQ ID NO: 11890 - DNA, 15 bp, Homo sapiens
ttttgtatttttttg

SEQ ID NO: 11891 - DNA, 15 bp, Homo sapiens
tttgtatttttttgt

SEQ ID NO: 11892 - DNA, 15 bp, Homo sapiens
ttgtatttttttgta

SEQ ID NO: 11893 - DNA, 15 bp, Homo sapiens
tgtatttttttgtaa

SEQ ID NO: 11894 - DNA, 15 bp, Homo sapiens
gtatttttttgtaaa

SEQ ID NO: 11895 - DNA, 15 bp, Homo sapiens
tatttttttgtaaag

SEQ ID NO: 11896 - DNA, 15 bp, Homo sapiens
atttttttgtaaaga

SEQ ID NO: 11897 - DNA, 15 bp, Homo sapiens
tttttttgtaaagac

SEQ ID NO: 11898 - DNA, 15 bp, Homo sapiens
ttttttgtaaagaca

SEQ ID NO: 11899 - DNA, 15 bp, Homo sapiens
tttttgtaaagacag

SEQ ID NO: 11900 - DNA, 15 bp, Homo sapiens
ttttgtaaagacagg

SEQ ID NO: 11901 - DNA, 15 bp, Homo sapiens
tttgtaaagacaggg

SEQ ID NO: 11902 - DNA, 15 bp, Homo sapiens
ttgtaaagacagggt

SEQ ID NO: 11903 - DNA, 15 bp, Homo sapiens
tgtaaagacagggtt

SEQ ID NO: 11904 - DNA, 15 bp, Homo sapiens
gtaaagacagggttt

SEQ ID NO: 11905 - DNA, 15 bp, Homo sapiens
taaagacagggtttc

SEQ ID NO: 11906 - DNA, 15 bp, Homo sapiens
aaagacagggtttca

SEQ ID NO: 11907 - DNA, 15 bp, Homo sapiens
aagacagggtttcac

SEQ ID NO: 11908 - DNA, 15 bp, Homo sapiens
agacagggtttcact

SEQ ID NO: 11909 - DNA, 15 bp, Homo sapiens
gacagggtttcactg

SEQ ID NO: 11910 - DNA, 15 bp, Homo sapiens
acagggtttcactgt

SEQ ID NO: 11911 - DNA, 15 bp, Homo sapiens
cagggtttcactgtg

SEQ ID NO: 11912 - DNA, 15 bp, Homo sapiens
agggtttcactgtgt

SEQ ID NO: 11913 - DNA, 15 bp, Homo sapiens
gggtttcactgtgtt

SEQ ID NO: 11914 - DNA, 15 bp, Homo sapiens
ggtttcactgtgtta

SEQ ID NO: 11915 - DNA, 15 bp, Homo sapiens
gtttcactgtgttag

SEQ ID NO: 11916 - DNA, 15 bp, Homo sapiens
tttcactgtgttagc

SEQ ID NO: 11917 - DNA, 15 bp, Homo sapiens
ttcactgtgttagcc

SEQ ID NO: 11918 - DNA, 15 bp, Homo sapiens
tcactgtgttagcca

SEQ ID NO: 11919 - DNA, 15 bp, Homo sapiens
cactgtgttagccag

SEQ ID NO: 11920 - DNA, 15 bp, Homo sapiens
actgtgttagccagg

SEQ ID NO: 11921 - DNA, 15 bp, Homo sapiens
ctgtgttagccagga

SEQ ID NO: 11922 - DNA, 15 bp, Homo sapiens
tgtgttagccaggat

SEQ ID NO: 11923 - DNA, 15 bp, Homo sapiens
ctcaatctcctgacc

SEQ ID NO: 11924 - DNA, 15 bp, Homo sapiens
tcaatctcctgaccc

SEQ ID NO: 11925 - DNA, 15 bp, Homo sapiens
caatctcctgacccc

SEQ ID NO: 11926 - DNA, 15 bp, Homo sapiens
aatctcctgaccccg

SEQ ID NO: 11927 - DNA, 15 bp, Homo sapiens
atctcctgaccccgt

SEQ ID NO: 11928 - DNA, 15 bp, Homo sapiens
tctcctgaccccgtg

SEQ ID NO: 11929 - DNA, 15 bp, Homo sapiens
ctcctgaccccgtga

SEQ ID NO: 11930 - DNA, 15 bp, Homo sapiens
tcctgaccccgtgat

SEQ ID NO: 11931 - DNA, 15 bp, Homo sapiens
cctgaccccgtgatc

SEQ ID NO: 11932 - DNA, 15 bp, Homo sapiens
ctgaccccgtgatcc

SEQ ID NO: 11933 - DNA, 15 bp, Homo sapiens
tgaccccgtgatcca

SEQ ID NO: 11934 - DNA, 15 bp, Homo sapiens
gaccccgtgatccac

SEQ ID NO: 11935 - DNA, 15 bp, Homo sapiens
accccgtgatccacc

SEQ ID NO: 11936 - DNA, 15 bp, Homo sapiens
ccccgtgatccaccc

SEQ ID NO: 11937 - DNA, 15 bp, Homo sapiens
cccgtgatccacccg

SEQ ID NO: 11938 - DNA, 15 bp, Homo sapiens
ccgtgatccacccgc

SEQ ID NO: 11939 - DNA, 15 bp, Homo sapiens
cgtgatccacccgcc

SEQ ID NO: 11940 - DNA, 15 bp, Homo sapiens
tgatccacccgcctc

SEQ ID NO: 11941 - DNA, 15 bp, Homo sapiens
gatccacccgcctcg

SEQ ID NO: 11942 - DNA, 15 bp, Homo sapiens
atccacccgcctcgg

SEQ ID NO: 11943 - DNA, 15 bp, Homo sapiens
tccacccgcctcggc

SEQ ID NO: 11944 - DNA, 15 bp, Homo sapiens
ccacccgcctcggcc

SEQ ID NO: 11945 - DNA, 15 bp, Homo sapiens
acccgcctcggcctt

SEQ ID NO: 11946 - DNA, 15 bp, Homo sapiens
cccgcctcggccttc

SEQ ID NO: 11947 - DNA, 15 bp, Homo sapiens
ccgcctcggccttcc

SEQ ID NO: 11948 - DNA, 15 bp, Homo sapiens
cgcctcggccttcca

SEQ ID NO: 11949 - DNA, 15 bp, Homo sapiens
gcctcggccttccaa

SEQ ID NO: 11950 - DNA, 15 bp, Homo sapiens
cctcggccttccaag

SEQ ID NO: 11951 - DNA, 15 bp, Homo sapiens
ctcggccttccaaga

SEQ ID NO: 11952 - DNA, 15 bp, Homo sapiens
tcggccttccaagag

SEQ ID NO: 11953 - DNA, 15 bp, Homo sapiens
cggccttccaagaga

SEQ ID NO: 11954 - DNA, 15 bp, Homo sapiens
ggccttccaagagaa

SEQ ID NO: 11955 - DNA, 15 bp, Homo sapiens
gccttccaagagaaa

SEQ ID NO: 11956 - DNA, 15 bp, Homo sapiens
ccttccaagagaaat

SEQ ID NO: 11957 - DNA, 15 bp, Homo sapiens
cttccaagagaaatg

SEQ ID NO: 11958 - DNA, 15 bp, Homo sapiens
ttccaagagaaatga

SEQ ID NO: 11959 - DNA, 15 bp, Homo sapiens
tccaagagaaatgaa

SEQ ID NO: 11960 - DNA, 15 bp, Homo sapiens
ccaagagaaatgaaa

SEQ ID NO: 11961 - DNA, 15 bp, Homo sapiens
caagagaaatgaaat

SEQ ID NO: 11962 - DNA, 15 bp, Homo sapiens
aagagaaatgaaatt

SEQ ID NO: 11963 - DNA, 15 bp, Homo sapiens
agagaaatgaaattt

SEQ ID NO: 11964 - DNA, 15 bp, Homo sapiens
gagaaatgaaatttt

SEQ ID NO: 11965 - DNA, 15 bp, Homo sapiens
agaaatgaaattttt

SEQ ID NO: 11966 - DNA, 15 bp, Homo sapiens
gaaatgaaatttttt

SEQ ID NO: 11967 - DNA, 15 bp, Homo sapiens
aaatgaaattttttt

SEQ ID NO: 11968 - DNA, 15 bp, Homo sapiens
aatgaaattttttta

SEQ ID NO: 11969 - DNA, 15 bp, Homo sapiens
atgaaatttttttaa

SEQ ID NO: 11970 - DNA, 15 bp, Homo sapiens
tgaaatttttttaat

SEQ ID NO: 11971 - DNA, 15 bp, Homo sapiens
gaaatttttttaatg

SEQ ID NO: 11972 - DNA, 15 bp, Homo sapiens
aaatttttttaatgc

SEQ ID NO: 11973 - DNA, 15 bp, Homo sapiens
aatttttttaatgca

SEQ ID NO: 11974 - DNA, 15 bp, Homo sapiens
atttttttaatgcac

SEQ ID NO: 11975 - DNA, 15 bp, Homo sapiens
tttttttaatgcaca

SEQ ID NO: 11976 - DNA, 15 bp, Homo sapiens
ttttttaatgcacaa

SEQ ID NO: 11977 - DNA, 15 bp, Homo sapiens
tttttaatgcacaaa

SEQ ID NO: 11978 - DNA, 15 bp, Homo sapiens
ttttaatgcacaaag

SEQ ID NO: 11979 - DNA, 15 bp, Homo sapiens
tttaatgcacaaaga

SEQ ID NO: 11980 - DNA, 15 bp, Homo sapiens
ttaatgcacaaagat

SEQ ID NO: 11981 - DNA, 15 bp, Homo sapiens
taatgcacaaagatc

SEQ ID NO: 11982 - DNA, 15 bp, Homo sapiens
aatgcacaaagatct

SEQ ID NO: 11983 - DNA, 15 bp, Homo sapiens
atgcacaaagatctg

SEQ ID NO: 11984 - DNA, 15 bp, Homo sapiens
tgcacaaagatctgg

SEQ ID NO: 11985 - DNA, 15 bp, Homo sapiens
gcacaaagatctggg

SEQ ID NO: 11986 - DNA, 15 bp, Homo sapiens
cacaaagatctgggg

SEQ ID NO: 11987 - DNA, 15 bp, Homo sapiens
acaaagatctggggt

SEQ ID NO: 11988 - DNA, 15 bp, Homo sapiens
caaagatctggggta

SEQ ID NO: 11989 - DNA, 15 bp, Homo sapiens
aaagatctggggtaa

SEQ ID NO: 11990 - DNA, 15 bp, Homo sapiens
aagatctggggtaat

SEQ ID NO: 11991 - DNA, 15 bp, Homo sapiens
agatctggggtaatg

SEQ ID NO: 11992 - DNA, 15 bp, Homo sapiens
gatctggggtaatgt

SEQ ID NO: 11993 - DNA, 15 bp, Homo sapiens
atctggggtaatgtg

SEQ ID NO: 11994 - DNA, 15 bp, Homo sapiens
tctggggtaatgtgt

SEQ ID NO: 11995 - DNA, 15 bp, Homo sapiens
ctggggtaatgtgta

SEQ ID NO: 11996 - DNA, 15 bp, Homo sapiens
tggggtaatgtgtac

SEQ ID NO: 11997 - DNA, 15 bp, Homo sapiens
ggggtaatgtgtacc

SEQ ID NO: 11998 - DNA, 15 bp, Homo sapiens
gggtaatgtgtacca

SEQ ID NO: 11999 - DNA, 15 bp, Homo sapiens
ggtaatgtgtaccac

SEQ ID NO: 12000 - DNA, 15 bp, Homo sapiens
gtaatgtgtaccaca

SEQ ID NO: 12001 - DNA, 15 bp, Homo sapiens
taatgtgtaccacat

SEQ ID NO: 12002 - DNA, 15 bp, Homo sapiens
aatgtgtaccacatt

SEQ ID NO: 12003 - DNA, 15 bp, Homo sapiens
atgtgtaccacattg

SEQ ID NO: 12004 - DNA, 15 bp, Homo sapiens
tgtgtaccacattga

SEQ ID NO: 12005 - DNA, 15 bp, Homo sapiens
gtgtaccacattgaa

SEQ ID NO: 12006 - DNA, 15 bp, Homo sapiens
tgtaccacattgaac

SEQ ID NO: 12007 - DNA, 15 bp, Homo sapiens
gtaccacattgaacc

SEQ ID NO: 12008 - DNA, 15 bp, Homo sapiens
taccacattgaacct

SEQ ID NO: 12009 - DNA, 15 bp, Homo sapiens
accacattgaacctt

SEQ ID NO: 12010 - DNA, 15 bp, Homo sapiens
ccacattgaaccttg

SEQ ID NO: 12011 - DNA, 15 bp, Homo sapiens
cacattgaaccttgg

SEQ ID NO: 12012 - DNA, 15 bp, Homo sapiens
acattgaaccttggg

SEQ ID NO: 12013 - DNA, 15 bp, Homo sapiens
cattgaaccttgggg

SEQ ID NO: 12014 - DNA, 15 bp, Homo sapiens
attgaaccttgggga

SEQ ID NO: 12015 - DNA, 15 bp, Homo sapiens
ttgaaccttggggag

SEQ ID NO: 12016 - DNA, 15 bp, Homo sapiens
tgaaccttggggagt

SEQ ID NO: 12017 - DNA, 15 bp, Homo sapiens
gaaccttggggagta

SEQ ID NO: 12018 - DNA, 15 bp, Homo sapiens
aaccttggggagtat

SEQ ID NO: 12019 - DNA, 15 bp, Homo sapiens
accttggggagtatg

SEQ ID NO: 12020 - DNA, 15 bp, Homo sapiens
ccttggggagtatgg

SEQ ID NO: 12021 - DNA, 15 bp, Homo sapiens
cttggggagtatggc

SEQ ID NO: 12022 - DNA, 15 bp, Homo sapiens
ttggggagtatggct

SEQ ID NO: 12023 - DNA, 15 bp, Homo sapiens
tggggagtatggctt

SEQ ID NO: 12024 - DNA, 15 bp, Homo sapiens
ggggagtatggcttc

SEQ ID NO: 12025 - DNA, 15 bp, Homo sapiens
gggagtatggcttca

SEQ ID NO: 12026 - DNA, 15 bp, Homo sapiens
ggagtatggcttcaa

SEQ ID NO: 12027 - DNA, 15 bp, Homo sapiens
gagtatggcttcaaa

SEQ ID NO: 12028 - DNA, 15 bp, Homo sapiens
agtatggcttcaaac

SEQ ID NO: 12029 - DNA, 15 bp, Homo sapiens
gtatggcttcaaact

SEQ ID NO: 12030 - DNA, 15 bp, Homo sapiens
tatggcttcaaactt

SEQ ID NO: 12031 - DNA, 15 bp, Homo sapiens
atggcttcaaacttg

SEQ ID NO: 12032 - DNA, 15 bp, Homo sapiens
tggcttcaaacttgt

SEQ ID NO: 12033 - DNA, 15 bp, Homo sapiens
ggcttcaaacttgtc

SEQ ID NO: 12034 - DNA, 15 bp, Homo sapiens
gcttcaaacttgtca

SEQ ID NO: 12035 - DNA, 15 bp, Homo sapiens
cttcaaacttgtcac

SEQ ID NO: 12036 - DNA, 15 bp, Homo sapiens
ttcaaacttgtcact

SEQ ID NO: 12037 - DNA, 15 bp, Homo sapiens
tcaaacttgtcactt

SEQ ID NO: 12038 - DNA, 15 bp, Homo sapiens
caaacttgtcacttt

SEQ ID NO: 12039 - DNA, 15 bp, Homo sapiens
aaacttgtcacttta

SEQ ID NO: 12040 - DNA, 15 bp, Homo sapiens
aacttgtcactttat

SEQ ID NO: 12041 - DNA, 15 bp, Homo sapiens
acttgtcactttata

SEQ ID NO: 12042 - DNA, 15 bp, Homo sapiens
cttgtcactttatac

SEQ ID NO: 12043 - DNA, 15 bp, Homo sapiens
ttgtcactttatacg

SEQ ID NO: 12044 - DNA, 15 bp, Homo sapiens
tgtcactttatacgt

SEQ ID NO: 12045 - DNA, 15 bp, Homo sapiens
gtcactttatacgtt

SEQ ID NO: 12046 - DNA, 15 bp, Homo sapiens
tcactttatacgtta

SEQ ID NO: 12047 - DNA, 15 bp, Homo sapiens
cactttatacgttag

SEQ ID NO: 12048 - DNA, 15 bp, Homo sapiens
actttatacgttagt

SEQ ID NO: 12049 - DNA, 15 bp, Homo sapiens
ctttatacgttagtc

SEQ ID NO: 12050 - DNA, 15 bp, Homo sapiens
tttatacgttagtct

SEQ ID NO: 12051 - DNA, 15 bp, Homo sapiens
ttatacgttagtctc

SEQ ID NO: 12052 - DNA, 15 bp, Homo sapiens
tatacgttagtctcc

SEQ ID NO: 12053 - DNA, 15 bp, Homo sapiens
atacgttagtctcct

SEQ ID NO: 12054 - DNA, 15 bp, Homo sapiens
tacgttagtctccta

SEQ ID NO: 12055 - DNA, 15 bp, Homo sapiens
acgttagtctcctac

SEQ ID NO: 12056 - DNA, 15 bp, Homo sapiens
cgttagtctcctacg

SEQ ID NO: 12057 - DNA, 15 bp, Homo sapiens
gttagtctcctacgg

SEQ ID NO: 12058 - DNA, 15 bp, Homo sapiens
ttagtctcctacgga

SEQ ID NO: 12059 - DNA, 15 bp, Homo sapiens
tagtctcctacggac

SEQ ID NO: 12060 - DNA, 15 bp, Homo sapiens
agtctcctacggaca

SEQ ID NO: 12061 - DNA, 15 bp, Homo sapiens
gtctcctacggacat

SEQ ID NO: 12062 - DNA, 15 bp, Homo sapiens
tctcctacggacatg

SEQ ID NO: 12063 - DNA, 15 bp, Homo sapiens
ctcctacggacatgt

SEQ ID NO: 12064 - DNA, 15 bp, Homo sapiens
tcctacggacatgtt

SEQ ID NO: 12065 - DNA, 15 bp, Homo sapiens
cctacggacatgttc

SEQ ID NO: 12066 - DNA, 15 bp, Homo sapiens
ctacggacatgttct

SEQ ID NO: 12067 - DNA, 15 bp, Homo sapiens
tacggacatgttcta

SEQ ID NO: 12068 - DNA, 15 bp, Homo sapiens
acggacatgttctat

SEQ ID NO: 12069 - DNA, 15 bp, Homo sapiens
cggacatgttctatt

SEQ ID NO: 12070 - DNA, 15 bp, Homo sapiens
ggacatgttctattg

SEQ ID NO: 12071 - DNA, 15 bp, Homo sapiens
gacatgttctattgt

SEQ ID NO: 12072 - DNA, 15 bp, Homo sapiens
acatgttctattgta

SEQ ID NO: 12073 - DNA, 15 bp, Homo sapiens
catgttctattgtat

SEQ ID NO: 12074 - DNA, 15 bp, Homo sapiens
atgttctattgtatt

SEQ ID NO: 12075 - DNA, 15 bp, Homo sapiens
tgttctattgtattt

SEQ ID NO: 12076 - DNA, 15 bp, Homo sapiens
gttctattgtatttt

SEQ ID NO: 12077 - DNA, 15 bp, Homo sapiens
ttctattgtatttta

SEQ ID NO: 12078 - DNA, 15 bp, Homo sapiens
tctattgtattttag

SEQ ID NO: 12079 - DNA, 15 bp, Homo sapiens
ctattgtattttagt

SEQ ID NO: 12080 - DNA, 15 bp, Homo sapiens
tattgtattttagtc

SEQ ID NO: 12081 - DNA, 15 bp, Homo sapiens
attgtattttagtca

SEQ ID NO: 12082 - DNA, 15 bp, Homo sapiens
ttgtattttagtcag

SEQ ID NO: 12083 - DNA, 15 bp, Homo sapiens
tgtattttagtcaga

SEQ ID NO: 12084 - DNA, 15 bp, Homo sapiens
gtattttagtcagaa

SEQ ID NO: 12085 - DNA, 15 bp, Homo sapiens
tattttagtcagaac

SEQ ID NO: 12086 - DNA, 15 bp, Homo sapiens
attttagtcagaaca

SEQ ID NO: 12087 - DNA, 15 bp, Homo sapiens
ttttagtcagaacat

SEQ ID NO: 12088 - DNA, 15 bp, Homo sapiens
tttagtcagaacatt

SEQ ID NO: 12089 - DNA, 15 bp, Homo sapiens
ttagtcagaacattt

SEQ ID NO: 12090 - DNA, 15 bp, Homo sapiens
tagtcagaacattta

SEQ ID NO: 12091 - DNA, 15 bp, Homo sapiens
agtcagaacatttaa

SEQ ID NO: 12092 - DNA, 15 bp, Homo sapiens
gtcagaacatttaaa

SEQ ID NO: 12093 - DNA, 15 bp, Homo sapiens
tcagaacatttaaaa

SEQ ID NO: 12094 - DNA, 15 bp, Homo sapiens
cagaacatttaaaat

SEQ ID NO: 12095 - DNA, 15 bp, Homo sapiens
agaacatttaaaatt

SEQ ID NO: 12096 - DNA, 15 bp, Homo sapiens
gaacatttaaaatta

SEQ ID NO: 12097 - DNA, 15 bp, Homo sapiens
aacatttaaaattat

SEQ ID NO: 12098 - DNA, 15 bp, Homo sapiens
acatttaaaattatt

SEQ ID NO: 12099 - DNA, 15 bp, Homo sapiens
catttaaaattattt

SEQ ID NO: 12100 - DNA, 15 bp, Homo sapiens
atttaaaattatttt

SEQ ID NO: 12101 - DNA, 15 bp, Homo sapiens
tttaaaattatttta

SEQ ID NO: 12102 - DNA, 15 bp, Homo sapiens
ttaaaattattttat

SEQ ID NO: 12103 - DNA, 15 bp, Homo sapiens
taaaattattttatt

SEQ ID NO: 12104 - DNA, 15 bp, Homo sapiens
aaaattattttattt

SEQ ID NO: 12105 - DNA, 15 bp, Homo sapiens
aaattattttatttt

SEQ ID NO: 12106 - DNA, 15 bp, Homo sapiens
aattattttatttta

SEQ ID NO: 12107 - DNA, 15 bp, Homo sapiens
attattttattttat

SEQ ID NO: 12108 - DNA, 15 bp, Homo sapiens
ttattttattttatt

SEQ ID NO: 12109 - DNA, 15 bp, Homo sapiens
tattttattttattt

SEQ ID NO: 12110 - DNA, 15 bp, Homo sapiens
attttattttatttt

SEQ ID NO: 12111 - DNA, 15 bp, Homo sapiens
ttttattttatttta

SEQ ID NO: 12112 - DNA, 15 bp, Homo sapiens
tttattttattttat

SEQ ID NO: 12113 - DNA, 15 bp, Homo sapiens
ttttattttattttt

SEQ ID NO: 12114 - DNA, 15 bp, Homo sapiens
tttattttatttttt

SEQ ID NO: 12115 - DNA, 15 bp, Homo sapiens
ttattttattttttt

SEQ ID NO: 12116 - DNA, 15 bp, Homo sapiens
tattttatttttttt

SEQ ID NO: 12117 - DNA, 15 bp, Homo sapiens
attttattttttttt

SEQ ID NO: 12118 - DNA, 15 bp, Homo sapiens
ttttatttttttttt

SEQ ID NO: 12119 - DNA, 15 bp, Homo sapiens
tgagacggagtctcg

SEQ ID NO: 12120 - DNA, 15 bp, Homo sapiens
gagacggagtctcgc

SEQ ID NO: 12121 - DNA, 15 bp, Homo sapiens
agacggagtctcgct

SEQ ID NO: 12122 - DNA, 15 bp, Homo sapiens
gacggagtctcgctc

SEQ ID NO: 12123 - DNA, 15 bp, Homo sapiens
acggagtctcgctct

SEQ ID NO: 12124 - DNA, 15 bp, Homo sapiens
cggagtctcgctctg

SEQ ID NO: 12125 - DNA, 15 bp, Homo sapiens
ggagtctcgctctgt

SEQ ID NO: 12126 - DNA, 15 bp, Homo sapiens
gagtctcgctctgtc

SEQ ID NO: 12127 - DNA, 15 bp, Homo sapiens
agtctcgctctgtca

SEQ ID NO: 12128 - DNA, 15 bp, Homo sapiens
gtctcgctctgtcac

SEQ ID NO: 12129 - DNA, 15 bp, Homo sapiens
tctcgctctgtcacc

SEQ ID NO: 12130 - DNA, 15 bp, Homo sapiens
ctcgctctgtcaccc

SEQ ID NO: 12131 - DNA, 15 bp, Homo sapiens
tcgctctgtcaccca

SEQ ID NO: 12132 - DNA, 15 bp, Homo sapiens
cgctctgtcacccag

SEQ ID NO: 12133 - DNA, 15 bp, Homo sapiens
gctctgtcacccagg

SEQ ID NO: 12134 - DNA, 15 bp, Homo sapiens
acccaggctggagta

SEQ ID NO: 12135 - DNA, 15 bp, Homo sapiens
tggagtacagtggcg

SEQ ID NO: 12136 - DNA, 15 bp, Homo sapiens
ggagtacagtggcgc

SEQ ID NO: 12137 - DNA, 15 bp, Homo sapiens
gagtacagtggcgca

SEQ ID NO: 12138 - DNA, 15 bp, Homo sapiens
agtacagtggcgcag

SEQ ID NO: 12139 - DNA, 15 bp, Homo sapiens
gtacagtggcgcagt

SEQ ID NO: 12140 - DNA, 15 bp, Homo sapiens
tacagtggcgcagtc

SEQ ID NO: 12141 - DNA, 15 bp, Homo sapiens
acagtggcgcagtct

SEQ ID NO: 12142 - DNA, 15 bp, Homo sapiens
cagtggcgcagtctc

SEQ ID NO: 12143 - DNA, 15 bp, Homo sapiens
agtggcgcagtctcg

SEQ ID NO: 12144 - DNA, 15 bp, Homo sapiens
gtggcgcagtctcgg

SEQ ID NO: 12145 - DNA, 15 bp, Homo sapiens
tggcgcagtctcggc

SEQ ID NO: 12146 - DNA, 15 bp, Homo sapiens
ggcgcagtctcggct

SEQ ID NO: 12147 - DNA, 15 bp, Homo sapiens
gcgcagtctcggctc

SEQ ID NO: 12148 - DNA, 15 bp, Homo sapiens
cgcagtctcggctca

SEQ ID NO: 12149 - DNA, 15 bp, Homo sapiens
gcagtctcggctcac

SEQ ID NO: 12150 - DNA, 15 bp, Homo sapiens
cagtctcggctcact

SEQ ID NO: 12151 - DNA, 15 bp, Homo sapiens
agtctcggctcactg

SEQ ID NO: 12152 - DNA, 15 bp, Homo sapiens
gtctcggctcactgc

SEQ ID NO: 12153 - DNA, 15 bp, Homo sapiens
agctccgcctcccgg

SEQ ID NO: 12154 - DNA, 15 bp, Homo sapiens
gctccgcctcccggg

SEQ ID NO: 12155 - DNA, 15 bp, Homo sapiens
gcctcccgggttcac

SEQ ID NO: 12156 - DNA, 15 bp, Homo sapiens
cctcccgggttcacg

SEQ ID NO: 12157 - DNA, 15 bp, Homo sapiens
ctcccgggttcacgc

SEQ ID NO: 12158 - DNA, 15 bp, Homo sapiens
tcccgggttcacgcc

SEQ ID NO: 12159 - DNA, 15 bp, Homo sapiens
cccgggttcacgcca

SEQ ID NO: 12160 - DNA, 15 bp, Homo sapiens
ccgggttcacgccat

SEQ ID NO: 12161 - DNA, 15 bp, Homo sapiens
cgggttcacgccatt

SEQ ID NO: 12162 - DNA, 15 bp, Homo sapiens
gggttcacgccattc

SEQ ID NO: 12163 - DNA, 15 bp, Homo sapiens
cctgcctcagcctct

SEQ ID NO: 12164 - DNA, 15 bp, Homo sapiens
ctgcctcagcctctc

SEQ ID NO: 12165 - DNA, 15 bp, Homo sapiens
tgcctcagcctctcc

SEQ ID NO: 12166 - DNA, 15 bp, Homo sapiens
gcctcagcctctccg

SEQ ID NO: 12167 - DNA, 15 bp, Homo sapiens
cctcagcctctccga

SEQ ID NO: 12168 - DNA, 15 bp, Homo sapiens
ctcagcctctccgag

SEQ ID NO: 12169 - DNA, 15 bp, Homo sapiens
tcagcctctccgagt

SEQ ID NO: 12170 - DNA, 15 bp, Homo sapiens
cagcctctccgagta

SEQ ID NO: 12171 - DNA, 15 bp, Homo sapiens
agcctctccgagtag

SEQ ID NO: 12172 - DNA, 15 bp, Homo sapiens
gcctctccgagtagc

SEQ ID NO: 12173 - DNA, 15 bp, Homo sapiens
cctctccgagtagct

SEQ ID NO: 12174 - DNA, 15 bp, Homo sapiens
ctctccgagtagctg

SEQ ID NO: 12175 - DNA, 15 bp, Homo sapiens
tctccgagtagctgg

SEQ ID NO: 12176 - DNA, 15 bp, Homo sapiens
ctccgagtagctggg

SEQ ID NO: 12177 - DNA, 15 bp, Homo sapiens
tccgagtagctggga

SEQ ID NO: 12178 - DNA, 15 bp, Homo sapiens
ccgccaccacgcccg

SEQ ID NO: 12179 - DNA, 15 bp, Homo sapiens
gcccggctaattttt

SEQ ID NO: 12180 - DNA, 15 bp, Homo sapiens
ccggctaattttttt

SEQ ID NO: 12181 - DNA, 15 bp, Homo sapiens
cggctaatttttttt

SEQ ID NO: 12182 - DNA, 15 bp, Homo sapiens
ggctaattttttttt

SEQ ID NO: 12183 - DNA, 15 bp, Homo sapiens
gctaattttttttta

SEQ ID NO: 12184 - DNA, 15 bp, Homo sapiens
ctaatttttttttat

SEQ ID NO: 12185 - DNA, 15 bp, Homo sapiens
taatttttttttatt

SEQ ID NO: 12186 - DNA, 15 bp, Homo sapiens
aatttttttttattt

SEQ ID NO: 12187 - DNA, 15 bp, Homo sapiens
atttttttttatttt

SEQ ID NO: 12188 - DNA, 15 bp, Homo sapiens
tttttttttattttt

SEQ ID NO: 12189 - DNA, 15 bp, Homo sapiens
ttttttttattttta

SEQ ID NO: 12190 - DNA, 15 bp, Homo sapiens
tttttttatttttag

SEQ ID NO: 12191 - DNA, 15 bp, Homo sapiens
ttttttatttttagt

SEQ ID NO: 12192 - DNA, 15 bp, Homo sapiens
tttttatttttagta

SEQ ID NO: 12193 - DNA, 15 bp, Homo sapiens
ttttatttttagtag

SEQ ID NO: 12194 - DNA, 15 bp, Homo sapiens
tttatttttagtaga

SEQ ID NO: 12195 - DNA, 15 bp, Homo sapiens
ttatttttagtagag

SEQ ID NO: 12196 - DNA, 15 bp, Homo sapiens
ggggtttcaccgtgg

SEQ ID NO: 12197 - DNA, 15 bp, Homo sapiens
gggtttcaccgtggt

SEQ ID NO: 12198 - DNA, 15 bp, Homo sapiens
ggtttcaccgtggtc

SEQ ID NO: 12199 - DNA, 15 bp, Homo sapiens
gtttcaccgtggtct

SEQ ID NO: 12200 - DNA, 15 bp, Homo sapiens
tttcaccgtggtctc

SEQ ID NO: 12201 - DNA, 15 bp, Homo sapiens
ttcaccgtggtctca

SEQ ID NO: 12202 - DNA, 15 bp, Homo sapiens
tcaccgtggtctcaa

SEQ ID NO: 12203 - DNA, 15 bp, Homo sapiens
caccgtggtctcaat

SEQ ID NO: 12204 - DNA, 15 bp, Homo sapiens
accgtggtctcaatc

SEQ ID NO: 12205 - DNA, 15 bp, Homo sapiens
ccgtggtctcaatct

SEQ ID NO: 12206 - DNA, 15 bp, Homo sapiens
cgtggtctcaatctc

SEQ ID NO: 12207 - DNA, 15 bp, Homo sapiens
gtggtctcaatctcc

SEQ ID NO: 12208 - DNA, 15 bp, Homo sapiens
tcaatctcctgacct

SEQ ID NO: 12209 - DNA, 15 bp, Homo sapiens
caatctcctgacctc

SEQ ID NO: 12210 - DNA, 15 bp, Homo sapiens
aatctcctgacctcg

SEQ ID NO: 12211 - DNA, 15 bp, Homo sapiens
ctcgtgatccacccg

SEQ ID NO: 12212 - DNA, 15 bp, Homo sapiens
tcgtgatccacccgc

SEQ ID NO: 12213 - DNA, 15 bp, Homo sapiens
ctgggattacaagcg

SEQ ID NO: 12214 - DNA, 15 bp, Homo sapiens
tgggattacaagcgt

SEQ ID NO: 12215 - DNA, 15 bp, Homo sapiens
gggattacaagcgtg

SEQ ID NO: 12216 - DNA, 15 bp, Homo sapiens
ggattacaagcgtga

SEQ ID NO: 12217 - DNA, 15 bp, Homo sapiens
gattacaagcgtgag

SEQ ID NO: 12218 - DNA, 15 bp, Homo sapiens
attacaagcgtgagc

SEQ ID NO: 12219 - DNA, 15 bp, Homo sapiens
ttacaagcgtgagcc

SEQ ID NO: 12220 - DNA, 15 bp, Homo sapiens
tacaagcgtgagcca

SEQ ID NO: 12221 - DNA, 15 bp, Homo sapiens
acaagcgtgagccac

SEQ ID NO: 12222 - DNA, 15 bp, Homo sapiens
caagcgtgagccacc

SEQ ID NO: 12223 - DNA, 15 bp, Homo sapiens
aagcgtgagccaccg

SEQ ID NO: 12224 - DNA, 15 bp, Homo sapiens
agcgtgagccaccgc

SEQ ID NO: 12225 - DNA, 15 bp, Homo sapiens
tgagccaccgcgccc

SEQ ID NO: 12226 - DNA, 15 bp, Homo sapiens
gagccaccgcgcccg

SEQ ID NO: 12227 - DNA, 15 bp, Homo sapiens
agccaccgcgcccgg

SEQ ID NO: 12228 - DNA, 15 bp, Homo sapiens
gccaccgcgcccggc

SEQ ID NO: 12229 - DNA, 15 bp, Homo sapiens
ccaccgcgcccggcc

SEQ ID NO: 12230 - DNA, 15 bp, Homo sapiens
caccgcgcccggcct

SEQ ID NO: 12231 - DNA, 15 bp, Homo sapiens
accgcgcccggccta

SEQ ID NO: 12232 - DNA, 15 bp, Homo sapiens
ccgcgcccggcctaa

SEQ ID NO: 12233 - DNA, 15 bp, Homo sapiens
cgcgcccggcctaaa

SEQ ID NO: 12234 - DNA, 15 bp, Homo sapiens
gcgcccggcctaaaa

SEQ ID NO: 12235 - DNA, 15 bp, Homo sapiens
cgcccggcctaaaat

SEQ ID NO: 12236 - DNA, 15 bp, Homo sapiens
gcccggcctaaaatt

SEQ ID NO: 12237 - DNA, 15 bp, Homo sapiens
cccggcctaaaatta

SEQ ID NO: 12238 - DNA, 15 bp, Homo sapiens
ccggcctaaaattat

SEQ ID NO: 12239 - DNA, 15 bp, Homo sapiens
cggcctaaaattatt

SEQ ID NO: 12240 - DNA, 15 bp, Homo sapiens
ggcctaaaattattt

SEQ ID NO: 12241 - DNA, 15 bp, Homo sapiens
gcctaaaattatttt

SEQ ID NO: 12242 - DNA, 15 bp, Homo sapiens
cctaaaattattttt

SEQ ID NO: 12243 - DNA, 15 bp, Homo sapiens
ctaaaattattttta

SEQ ID NO: 12244 - DNA, 15 bp, Homo sapiens
taaaattatttttaa

SEQ ID NO: 12245 - DNA, 15 bp, Homo sapiens
aaaattatttttaaa

SEQ ID NO: 12246 - DNA, 15 bp, Homo sapiens
aaattatttttaaaa

SEQ ID NO: 12247 - DNA, 15 bp, Homo sapiens
aattatttttaaaag

SEQ ID NO: 12248 - DNA, 15 bp, Homo sapiens
attatttttaaaagt

SEQ ID NO: 12249 - DNA, 15 bp, Homo sapiens
ttatttttaaaagta

SEQ ID NO: 12250 - DNA, 15 bp, Homo sapiens
tatttttaaaagtaa

SEQ ID NO: 12251 - DNA, 15 bp, Homo sapiens
atttttaaaagtaag

SEQ ID NO: 12252 - DNA, 15 bp, Homo sapiens
tttttaaaagtaagc

SEQ ID NO: 12253 - DNA, 15 bp, Homo sapiens
ttttaaaagtaagct

SEQ ID NO: 12254 - DNA, 15 bp, Homo sapiens
tttaaaagtaagctc

SEQ ID NO: 12255 - DNA, 15 bp, Homo sapiens
ttaaaagtaagctct

SEQ ID NO: 12256 - DNA, 15 bp, Homo sapiens
taaaagtaagctctt

SEQ ID NO: 12257 - DNA, 15 bp, Homo sapiens
aaaagtaagctcttg

SEQ ID NO: 12258 - DNA, 15 bp, Homo sapiens
aaagtaagctcttgt

SEQ ID NO: 12259 - DNA, 15 bp, Homo sapiens
aagtaagctcttgtg

SEQ ID NO: 12260 - DNA, 15 bp, Homo sapiens
agtaagctcttgtgc

SEQ ID NO: 12261 - DNA, 15 bp, Homo sapiens
gtaagctcttgtgcc

SEQ ID NO: 12262 - DNA, 15 bp, Homo sapiens
taagctcttgtgccc

SEQ ID NO: 12263 - DNA, 15 bp, Homo sapiens
aagctcttgtgccct

SEQ ID NO: 12264 - DNA, 15 bp, Homo sapiens
agctcttgtgccctg

SEQ ID NO: 12265 - DNA, 15 bp, Homo sapiens
gctcttgtgccctgc

SEQ ID NO: 12266 - DNA, 15 bp, Homo sapiens
ctcttgtgccctgct

SEQ ID NO: 12267 - DNA, 15 bp, Homo sapiens
tcttgtgccctgcta

SEQ ID NO: 12268 - DNA, 15 bp, Homo sapiens
cttgtgccctgctaa

SEQ ID NO: 12269 - DNA, 15 bp, Homo sapiens
ttgtgccctgctaaa

SEQ ID NO: 12270 - DNA, 15 bp, Homo sapiens
tgtgccctgctaaaa

SEQ ID NO: 12271 - DNA, 15 bp, Homo sapiens
gtgccctgctaaaat

SEQ ID NO: 12272 - DNA, 15 bp, Homo sapiens
tgccctgctaaaatt

SEQ ID NO: 12273 - DNA, 15 bp, Homo sapiens
gccctgctaaaatta

SEQ ID NO: 12274 - DNA, 15 bp, Homo sapiens
ccctgctaaaattat

SEQ ID NO: 12275 - DNA, 15 bp, Homo sapiens
cctgctaaaattatg

SEQ ID NO: 12276 - DNA, 15 bp, Homo sapiens
ctgctaaaattatga

SEQ ID NO: 12277 - DNA, 15 bp, Homo sapiens
tgctaaaattatgat

SEQ ID NO: 12278 - DNA, 15 bp, Homo sapiens
gctaaaattatgatg

SEQ ID NO: 12279 - DNA, 15 bp, Homo sapiens
ctaaaattatgatgt

SEQ ID NO: 12280 - DNA, 15 bp, Homo sapiens
taaaattatgatgtg

SEQ ID NO: 12281 - DNA, 15 bp, Homo sapiens
aaaattatgatgtga

SEQ ID NO: 12282 - DNA, 15 bp, Homo sapiens
aaattatgatgtgat

SEQ ID NO: 12283 - DNA, 15 bp, Homo sapiens
aattatgatgtgata

SEQ ID NO: 12284 - DNA, 15 bp, Homo sapiens
attatgatgtgatat

SEQ ID NO: 12285 - DNA, 15 bp, Homo sapiens
ttatgatgtgatatt

SEQ ID NO: 12286 - DNA, 15 bp, Homo sapiens
tatgatgtgatattg

SEQ ID NO: 12287 - DNA, 15 bp, Homo sapiens
atgatgtgatattgt

SEQ ID NO: 12288 - DNA, 15 bp, Homo sapiens
tgatgtgatattgta

SEQ ID NO: 12289 - DNA, 15 bp, Homo sapiens
gatgtgatattgtag

SEQ ID NO: 12290 - DNA, 15 bp, Homo sapiens
atgtgatattgtagg

SEQ ID NO: 12291 - DNA, 15 bp, Homo sapiens
tgtgatattgtaggc

SEQ ID NO: 12292 - DNA, 15 bp, Homo sapiens
gtgatattgtaggca

SEQ ID NO: 12293 - DNA, 15 bp, Homo sapiens
tgatattgtaggcac

SEQ ID NO: 12294 - DNA, 15 bp, Homo sapiens
gatattgtaggcact

SEQ ID NO: 12295 - DNA, 15 bp, Homo sapiens
atattgtaggcactt

SEQ ID NO: 12296 - DNA, 15 bp, Homo sapiens
tattgtaggcacttg

SEQ ID NO: 12297 - DNA, 15 bp, Homo sapiens
attgtaggcacttgt

SEQ ID NO: 12298 - DNA, 15 bp, Homo sapiens
ttgtaggcacttgta

SEQ ID NO: 12299 - DNA, 15 bp, Homo sapiens
tgtaggcacttgtat

SEQ ID NO: 12300 - DNA, 15 bp, Homo sapiens
gtaggcacttgtatt

SEQ ID NO: 12301 - DNA, 15 bp, Homo sapiens
taggcacttgtattt

SEQ ID NO: 12302 - DNA, 15 bp, Homo sapiens
aggcacttgtatttt

SEQ ID NO: 12303 - DNA, 15 bp, Homo sapiens
ggcacttgtattttt

SEQ ID NO: 12304 - DNA, 15 bp, Homo sapiens
gcacttgtattttta

SEQ ID NO: 12305 - DNA, 15 bp, Homo sapiens
cacttgtatttttag

SEQ ID NO: 12306 - DNA, 15 bp, Homo sapiens
acttgtatttttagt

SEQ ID NO: 12307 - DNA, 15 bp, Homo sapiens
cttgtatttttagta

SEQ ID NO: 12308 - DNA, 15 bp, Homo sapiens
ttgtatttttagtaa

SEQ ID NO: 12309 - DNA, 15 bp, Homo sapiens
tgtatttttagtaaa

SEQ ID NO: 12310 - DNA, 15 bp, Homo sapiens
gtatttttagtaaat

SEQ ID NO: 12311 - DNA, 15 bp, Homo sapiens
tatttttagtaaatt

SEQ ID NO: 12312 - DNA, 15 bp, Homo sapiens
atttttagtaaatta

SEQ ID NO: 12313 - DNA, 15 bp, Homo sapiens
tttttagtaaattaa

SEQ ID NO: 12314 - DNA, 15 bp, Homo sapiens
ttttagtaaattaat

SEQ ID NO: 12315 - DNA, 15 bp, Homo sapiens
tttagtaaattaata

SEQ ID NO: 12316 - DNA, 15 bp, Homo sapiens
ttagtaaattaatat

SEQ ID NO: 12317 - DNA, 15 bp, Homo sapiens
tagtaaattaatata

SEQ ID NO: 12318 - DNA, 15 bp, Homo sapiens
agtaaattaatatag

SEQ ID NO: 12319 - DNA, 15 bp, Homo sapiens
gtaaattaatataga

SEQ ID NO: 12320 - DNA, 15 bp, Homo sapiens
taaattaatatagaa

SEQ ID NO: 12321 - DNA, 15 bp, Homo sapiens
aaattaatatagaag

SEQ ID NO: 12322 - DNA, 15 bp, Homo sapiens
aattaatatagaaga

SEQ ID NO: 12323 - DNA, 15 bp, Homo sapiens
attaatatagaagaa

SEQ ID NO: 12324 - DNA, 15 bp, Homo sapiens
ttaatatagaagaaa

SEQ ID NO: 12325 - DNA, 15 bp, Homo sapiens
taatatagaagaaac

SEQ ID NO: 12326 - DNA, 15 bp, Homo sapiens
aatatagaagaaaca

SEQ ID NO: 12327 - DNA, 15 bp, Homo sapiens
atatagaagaaacaa

SEQ ID NO: 12328 - DNA, 15 bp, Homo sapiens
tatagaagaaacaac

SEQ ID NO: 12329 - DNA, 15 bp, Homo sapiens
atagaagaaacaact

SEQ ID NO: 12330 - DNA, 15 bp, Homo sapiens
tagaagaaacaactg

SEQ ID NO: 12331 - DNA, 15 bp, Homo sapiens
agaagaaacaactga

SEQ ID NO: 12332 - DNA, 15 bp, Homo sapiens
gaagaaacaactgac

SEQ ID NO: 12333 - DNA, 15 bp, Homo sapiens
aagaaacaactgact

SEQ ID NO: 12334 - DNA, 15 bp, Homo sapiens
agaaacaactgactt

SEQ ID NO: 12335 - DNA, 15 bp, Homo sapiens
gaaacaactgactta

SEQ ID NO: 12336 - DNA, 15 bp, Homo sapiens
aaacaactgacttaa

SEQ ID NO: 12337 - DNA, 15 bp, Homo sapiens
aacaactgacttaaa

SEQ ID NO: 12338 - DNA, 15 bp, Homo sapiens
acaactgacttaaag

SEQ ID NO: 12339 - DNA, 15 bp, Homo sapiens
caactgacttaaagg

SEQ ID NO: 12340 - DNA, 15 bp, Homo sapiens
aactgacttaaaggt

SEQ ID NO: 12341 - DNA, 15 bp, Homo sapiens
actgacttaaaggtg

SEQ ID NO: 12342 - DNA, 15 bp, Homo sapiens
ctgacttaaaggtgt

SEQ ID NO: 12343 - DNA, 15 bp, Homo sapiens
tgacttaaaggtgta

SEQ ID NO: 12344 - DNA, 15 bp, Homo sapiens
gacttaaaggtgtat

SEQ ID NO: 12345 - DNA, 15 bp, Homo sapiens
acttaaaggtgtatg

SEQ ID NO: 12346 - DNA, 15 bp, Homo sapiens
cttaaaggtgtatgt

SEQ ID NO: 12347 - DNA, 15 bp, Homo sapiens
ttaaaggtgtatgtt

SEQ ID NO: 12348 - DNA, 15 bp, Homo sapiens
taaaggtgtatgttt

SEQ ID NO: 12349 - DNA, 15 bp, Homo sapiens
aaaggtgtatgtttt

SEQ ID NO: 12350 - DNA, 15 bp, Homo sapiens
aaggtgtatgttttt

SEQ ID NO: 12351 - DNA, 15 bp, Homo sapiens
aggtgtatgttttta

SEQ ID NO: 12352 - DNA, 15 bp, Homo sapiens
ggtgtatgtttttaa

SEQ ID NO: 12353 - DNA, 15 bp, Homo sapiens
gtgtatgtttttaaa

SEQ ID NO: 12354 - DNA, 15 bp, Homo sapiens
tgtatgtttttaaat

SEQ ID NO: 12355 - DNA, 15 bp, Homo sapiens
gtatgtttttaaatg

SEQ ID NO: 12356 - DNA, 15 bp, Homo sapiens
tatgtttttaaatgt

SEQ ID NO: 12357 - DNA, 15 bp, Homo sapiens
atgtttttaaatgta

SEQ ID NO: 12358 - DNA, 15 bp, Homo sapiens
tgtttttaaatgtat

SEQ ID NO: 12359 - DNA, 15 bp, Homo sapiens
gtttttaaatgtatc

SEQ ID NO: 12360 - DNA, 15 bp, Homo sapiens
tttttaaatgtatca

SEQ ID NO: 12361 - DNA, 15 bp, Homo sapiens
ttttaaatgtatcat

SEQ ID NO: 12362 - DNA, 15 bp, Homo sapiens
tttaaatgtatcatc

SEQ ID NO: 12363 - DNA, 15 bp, Homo sapiens
ttaaatgtatcatct

SEQ ID NO: 12364 - DNA, 15 bp, Homo sapiens
taaatgtatcatctg

SEQ ID NO: 12365 - DNA, 15 bp, Homo sapiens
aaatgtatcatctgt

SEQ ID NO: 12366 - DNA, 15 bp, Homo sapiens
aatgtatcatctgtg

SEQ ID NO: 12367 - DNA, 15 bp, Homo sapiens
atgtatcatctgtgt

SEQ ID NO: 12368 - DNA, 15 bp, Homo sapiens
tgtatcatctgtgtg

SEQ ID NO: 12369 - DNA, 15 bp, Homo sapiens
gtatcatctgtgtgt

SEQ ID NO: 12370 - DNA, 15 bp, Homo sapiens
tatcatctgtgtgtg

SEQ ID NO: 12371 - DNA, 15 bp, Homo sapiens
atcatctgtgtgtgc

SEQ ID NO: 12372 - DNA, 15 bp, Homo sapiens
tcatctgtgtgtgcc

SEQ ID NO: 12373 - DNA, 15 bp, Homo sapiens
catctgtgtgtgccc

SEQ ID NO: 12374 - DNA, 15 bp, Homo sapiens
atctgtgtgtgcccc

SEQ ID NO: 12375 - DNA, 15 bp, Homo sapiens
tctgtgtgtgccccc

SEQ ID NO: 12376 - DNA, 15 bp, Homo sapiens
ctgtgtgtgccccca

SEQ ID NO: 12377 - DNA, 15 bp, Homo sapiens
tgtgtgtgcccccat

SEQ ID NO: 12378 - DNA, 15 bp, Homo sapiens
gtgtgtgcccccatt

SEQ ID NO: 12379 - DNA, 15 bp, Homo sapiens
tgtgtgcccccatta

SEQ ID NO: 12380 - DNA, 15 bp, Homo sapiens
gtgtgcccccattaa

SEQ ID NO: 12381 - DNA, 15 bp, Homo sapiens
tgtgcccccattaat

SEQ ID NO: 12382 - DNA, 15 bp, Homo sapiens
gtgcccccattaata

SEQ ID NO: 12383 - DNA, 15 bp, Homo sapiens
tgcccccattaatat

SEQ ID NO: 12384 - DNA, 15 bp, Homo sapiens
gcccccattaatatt

SEQ ID NO: 12385 - DNA, 15 bp, Homo sapiens
cccccattaatattc

SEQ ID NO: 12386 - DNA, 15 bp, Homo sapiens
ccccattaatattct

SEQ ID NO: 12387 - DNA, 15 bp, Homo sapiens
cccattaatattctt

SEQ ID NO: 12388 - DNA, 15 bp, Homo sapiens
ccattaatattctta

SEQ ID NO: 12389 - DNA, 15 bp, Homo sapiens
cattaatattcttat

SEQ ID NO: 12390 - DNA, 15 bp, Homo sapiens
attaatattcttatt

SEQ ID NO: 12391 - DNA, 15 bp, Homo sapiens
ttaatattcttattt

SEQ ID NO: 12392 - DNA, 15 bp, Homo sapiens
taatattcttattta

SEQ ID NO: 12393 - DNA, 15 bp, Homo sapiens
aatattcttatttaa

SEQ ID NO: 12394 - DNA, 15 bp, Homo sapiens
atattcttatttaaa

SEQ ID NO: 12395 - DNA, 15 bp, Homo sapiens
tattcttatttaaaa

SEQ ID NO: 12396 - DNA, 15 bp, Homo sapiens
attcttatttaaaag

SEQ ID NO: 12397 - DNA, 15 bp, Homo sapiens
ttcttatttaaaagt

SEQ ID NO: 12398 - DNA, 15 bp, Homo sapiens
tcttatttaaaagtt

SEQ ID NO: 12399 - DNA, 15 bp, Homo sapiens
cttatttaaaagtta

SEQ ID NO: 12400 - DNA, 15 bp, Homo sapiens
ttatttaaaagttaa

SEQ ID NO: 12401 - DNA, 15 bp, Homo sapiens
tatttaaaagttaag

SEQ ID NO: 12402 - DNA, 15 bp, Homo sapiens
atttaaaagttaagg

SEQ ID NO: 12403 - DNA, 15 bp, Homo sapiens
tttaaaagttaaggc

SEQ ID NO: 12404 - DNA, 15 bp, Homo sapiens
ttaaaagttaaggcc

SEQ ID NO: 12405 - DNA, 15 bp, Homo sapiens
taaaagttaaggcca

SEQ ID NO: 12406 - DNA, 15 bp, Homo sapiens
aaaagttaaggccag

SEQ ID NO: 12407 - DNA, 15 bp, Homo sapiens
aaagttaaggccaga

SEQ ID NO: 12408 - DNA, 15 bp, Homo sapiens
aagttaaggccagac

SEQ ID NO: 12409 - DNA, 15 bp, Homo sapiens
agttaaggccagaca

SEQ ID NO: 12410 - DNA, 15 bp, Homo sapiens
gttaaggccagacat

SEQ ID NO: 12411 - DNA, 15 bp, Homo sapiens
ttaaggccagacatg

SEQ ID NO: 12412 - DNA, 15 bp, Homo sapiens
taaggccagacatgg

SEQ ID NO: 12413 - DNA, 15 bp, Homo sapiens
aaggccagacatggt

SEQ ID NO: 12414 - DNA, 15 bp, Homo sapiens
aggccagacatggtg

SEQ ID NO: 12415 - DNA, 15 bp, Homo sapiens
ggccagacatggtgg

SEQ ID NO: 12416 - DNA, 15 bp, Homo sapiens
gccagacatggtggc

SEQ ID NO: 12417 - DNA, 15 bp, Homo sapiens
ccagacatggtggct

SEQ ID NO: 12418 - DNA, 15 bp, Homo sapiens
cagacatggtggctt

SEQ ID NO: 12419 - DNA, 15 bp, Homo sapiens
agacatggtggctta

SEQ ID NO: 12420 - DNA, 15 bp, Homo sapiens
gacatggtggcttac

SEQ ID NO: 12421 - DNA, 15 bp, Homo sapiens
acatggtggcttaca

SEQ ID NO: 12422 - DNA, 15 bp, Homo sapiens
catggtggcttacaa

SEQ ID NO: 12423 - DNA, 15 bp, Homo sapiens
atggtggcttacaac

SEQ ID NO: 12424 - DNA, 15 bp, Homo sapiens
tggtggcttacaact

SEQ ID NO: 12425 - DNA, 15 bp, Homo sapiens
ggtggcttacaactg

SEQ ID NO: 12426 - DNA, 15 bp, Homo sapiens
gtggcttacaactgt

SEQ ID NO: 12427 - DNA, 15 bp, Homo sapiens
tggcttacaactgta

SEQ ID NO: 12428 - DNA, 15 bp, Homo sapiens
ggcttacaactgtaa

SEQ ID NO: 12429 - DNA, 15 bp, Homo sapiens
gcttacaactgtaat

SEQ ID NO: 12430 - DNA, 15 bp, Homo sapiens
cttacaactgtaatc

SEQ ID NO: 12431 - DNA, 15 bp, Homo sapiens
ttacaactgtaatcc

SEQ ID NO: 12432 - DNA, 15 bp, Homo sapiens
tacaactgtaatccc

SEQ ID NO: 12433 - DNA, 15 bp, Homo sapiens
acaactgtaatccca

SEQ ID NO: 12434 - DNA, 15 bp, Homo sapiens
caactgtaatcccaa

SEQ ID NO: 12435 - DNA, 15 bp, Homo sapiens
aactgtaatcccaac

SEQ ID NO: 12436 - DNA, 15 bp, Homo sapiens
actgtaatcccaaca

SEQ ID NO: 12437 - DNA, 15 bp, Homo sapiens
ctgtaatcccaacag

SEQ ID NO: 12438 - DNA, 15 bp, Homo sapiens
tgtaatcccaacagt

SEQ ID NO: 12439 - DNA, 15 bp, Homo sapiens
gtaatcccaacagtt

SEQ ID NO: 12440 - DNA, 15 bp, Homo sapiens
taatcccaacagttt

SEQ ID NO: 12441 - DNA, 15 bp, Homo sapiens
aatcccaacagtttg

SEQ ID NO: 12442 - DNA, 15 bp, Homo sapiens
atcccaacagtttgt

SEQ ID NO: 12443 - DNA, 15 bp, Homo sapiens
tcccaacagtttgtg

SEQ ID NO: 12444 - DNA, 15 bp, Homo sapiens
cccaacagtttgtga

SEQ ID NO: 12445 - DNA, 15 bp, Homo sapiens
ccaacagtttgtgag

SEQ ID NO: 12446 - DNA, 15 bp, Homo sapiens
caacagtttgtgagg

SEQ ID NO: 12447 - DNA, 15 bp, Homo sapiens
aacagtttgtgaggc

SEQ ID NO: 12448 - DNA, 15 bp, Homo sapiens
acagtttgtgaggcc

SEQ ID NO: 12449 - DNA, 15 bp, Homo sapiens
cagtttgtgaggccg

SEQ ID NO: 12450 - DNA, 15 bp, Homo sapiens
agtttgtgaggccga

SEQ ID NO: 12451 - DNA, 15 bp, Homo sapiens
gtttgtgaggccgag

SEQ ID NO: 12452 - DNA, 15 bp, Homo sapiens
tttgtgaggccgagg

SEQ ID NO: 12453 - DNA, 15 bp, Homo sapiens
ttgtgaggccgaggc

SEQ ID NO: 12454 - DNA, 15 bp, Homo sapiens
tgtgaggccgaggca

SEQ ID NO: 12455 - DNA, 15 bp, Homo sapiens
gtgaggccgaggcag

SEQ ID NO: 12456 - DNA, 15 bp, Homo sapiens
tgaggccgaggcagg

SEQ ID NO: 12457 - DNA, 15 bp, Homo sapiens
gaggccgaggcaggc

SEQ ID NO: 12458 - DNA, 15 bp, Homo sapiens
aggccgaggcaggca

SEQ ID NO: 12459 - DNA, 15 bp, Homo sapiens
ggccgaggcaggcag

SEQ ID NO: 12460 - DNA, 15 bp, Homo sapiens
gccgaggcaggcaga

SEQ ID NO: 12461 - DNA, 15 bp, Homo sapiens
ccgaggcaggcagat

SEQ ID NO: 12462 - DNA, 15 bp, Homo sapiens
cgaggcaggcagatc

SEQ ID NO: 12463 - DNA, 15 bp, Homo sapiens
gaggcaggcagatca

SEQ ID NO: 12464 - DNA, 15 bp, Homo sapiens
aggcaggcagatcac

SEQ ID NO: 12465 - DNA, 15 bp, Homo sapiens
ggcaggcagatcact

SEQ ID NO: 12466 - DNA, 15 bp, Homo sapiens
gcaggcagatcactt

SEQ ID NO: 12467 - DNA, 15 bp, Homo sapiens
caggcagatcacttg

SEQ ID NO: 12468 - DNA, 15 bp, Homo sapiens
aggcagatcacttga

SEQ ID NO: 12469 - DNA, 15 bp, Homo sapiens
ggcagatcacttgag

SEQ ID NO: 12470 - DNA, 15 bp, Homo sapiens
gcagatcacttgagg

SEQ ID NO: 12471 - DNA, 15 bp, Homo sapiens
cagatcacttgaggt

SEQ ID NO: 12472 - DNA, 15 bp, Homo sapiens
gcctggccaacatga

SEQ ID NO: 12473 - DNA, 15 bp, Homo sapiens
cctggccaacatgat

SEQ ID NO: 12474 - DNA, 15 bp, Homo sapiens
ctggccaacatgatg

SEQ ID NO: 12475 - DNA, 15 bp, Homo sapiens
tggccaacatgatga

SEQ ID NO: 12476 - DNA, 15 bp, Homo sapiens
ggccaacatgatgaa

SEQ ID NO: 12477 - DNA, 15 bp, Homo sapiens
gccaacatgatgaaa

SEQ ID NO: 12478 - DNA, 15 bp, Homo sapiens
ccaacatgatgaaac

SEQ ID NO: 12479 - DNA, 15 bp, Homo sapiens
caacatgatgaaacc

SEQ ID NO: 12480 - DNA, 15 bp, Homo sapiens
aacatgatgaaacct

SEQ ID NO: 12481 - DNA, 15 bp, Homo sapiens
acatgatgaaacctt

SEQ ID NO: 12482 - DNA, 15 bp, Homo sapiens
catgatgaaaccttg

SEQ ID NO: 12483 - DNA, 15 bp, Homo sapiens
atgatgaaaccttgt

SEQ ID NO: 12484 - DNA, 15 bp, Homo sapiens
tgatgaaaccttgtc

SEQ ID NO: 12485 - DNA, 15 bp, Homo sapiens
gatgaaaccttgtct

SEQ ID NO: 12486 - DNA, 15 bp, Homo sapiens
atgaaaccttgtctc

SEQ ID NO: 12487 - DNA, 15 bp, Homo sapiens
tctactaaaaatacc

SEQ ID NO: 12488 - DNA, 15 bp, Homo sapiens
ctactaaaaatacca

SEQ ID NO: 12489 - DNA, 15 bp, Homo sapiens
tactaaaaataccaa

SEQ ID NO: 12490 - DNA, 15 bp, Homo sapiens
actaaaaataccaaa

SEQ ID NO: 12491 - DNA, 15 bp, Homo sapiens
ctaaaaataccaaaa

SEQ ID NO: 12492 - DNA, 15 bp, Homo sapiens
taaaaataccaaaaa

SEQ ID NO: 12493 - DNA, 15 bp, Homo sapiens
aaaaataccaaaaaa

SEQ ID NO: 12494 - DNA, 15 bp, Homo sapiens
aaaataccaaaaaaa

SEQ ID NO: 12495 - DNA, 15 bp, Homo sapiens
aaataccaaaaaaaa

SEQ ID NO: 12496 - DNA, 15 bp, Homo sapiens
aataccaaaaaaaat

SEQ ID NO: 12497 - DNA, 15 bp, Homo sapiens
ataccaaaaaaaatt

SEQ ID NO: 12498 - DNA, 15 bp, Homo sapiens
taccaaaaaaaattt

SEQ ID NO: 12499 - DNA, 15 bp, Homo sapiens
accaaaaaaaattta

SEQ ID NO: 12500 - DNA, 15 bp, Homo sapiens
ccaaaaaaaatttag

SEQ ID NO: 12501 - DNA, 15 bp, Homo sapiens
caaaaaaaatttagc

SEQ ID NO: 12502 - DNA, 15 bp, Homo sapiens
aaaaaaaatttagcc

SEQ ID NO: 12503 - DNA, 15 bp, Homo sapiens
aaaaaaatttagcca

SEQ ID NO: 12504 - DNA, 15 bp, Homo sapiens
aaaaaatttagccag

SEQ ID NO: 12505 - DNA, 15 bp, Homo sapiens
aaaaatttagccagg

SEQ ID NO: 12506 - DNA, 15 bp, Homo sapiens
aaaatttagccaggc

SEQ ID NO: 12507 - DNA, 15 bp, Homo sapiens
aaatttagccaggca

SEQ ID NO: 12508 - DNA, 15 bp, Homo sapiens
aatttagccaggcat

SEQ ID NO: 12509 - DNA, 15 bp, Homo sapiens
atttagccaggcatg

SEQ ID NO: 12510 - DNA, 15 bp, Homo sapiens
tttagccaggcatgg

SEQ ID NO: 12511 - DNA, 15 bp, Homo sapiens
ttagccaggcatggt

SEQ ID NO: 12512 - DNA, 15 bp, Homo sapiens
caggcatggtggcac

SEQ ID NO: 12513 - DNA, 15 bp, Homo sapiens
aggcatggtggcaca

SEQ ID NO: 12514 - DNA, 15 bp, Homo sapiens
ggcatggtggcacat

SEQ ID NO: 12515 - DNA, 15 bp, Homo sapiens
gcatggtggcacatg

SEQ ID NO: 12516 - DNA, 15 bp, Homo sapiens
catggtggcacatgc

SEQ ID NO: 12517 - DNA, 15 bp, Homo sapiens
atggtggcacatgcc

SEQ ID NO: 12518 - DNA, 15 bp, Homo sapiens
tggtggcacatgcct

SEQ ID NO: 12519 - DNA, 15 bp, Homo sapiens
ggtggcacatgcctg

SEQ ID NO: 12520 - DNA, 15 bp, Homo sapiens
gtggcacatgcctgt

SEQ ID NO: 12521 - DNA, 15 bp, Homo sapiens
tggcacatgcctgta

SEQ ID NO: 12522 - DNA, 15 bp, Homo sapiens
ggcacatgcctgtaa

SEQ ID NO: 12523 - DNA, 15 bp, Homo sapiens
gcacatgcctgtaat

SEQ ID NO: 12524 - DNA, 15 bp, Homo sapiens
cacatgcctgtaatc

SEQ ID NO: 12525 - DNA, 15 bp, Homo sapiens
acatgcctgtaatcc

SEQ ID NO: 12526 - DNA, 15 bp, Homo sapiens
catgcctgtaatccg

SEQ ID NO: 12527 - DNA, 15 bp, Homo sapiens
atgcctgtaatccga

SEQ ID NO: 12528 - DNA, 15 bp, Homo sapiens
tgcctgtaatccgag

SEQ ID NO: 12529 - DNA, 15 bp, Homo sapiens
gcctgtaatccgagc

SEQ ID NO: 12530 - DNA, 15 bp, Homo sapiens
cctgtaatccgagct

SEQ ID NO: 12531 - DNA, 15 bp, Homo sapiens
ctgtaatccgagcta

SEQ ID NO: 12532 - DNA, 15 bp, Homo sapiens
tgtaatccgagctac

SEQ ID NO: 12533 - DNA, 15 bp, Homo sapiens
gtaatccgagctact

SEQ ID NO: 12534 - DNA, 15 bp, Homo sapiens
taatccgagctactt

SEQ ID NO: 12535 - DNA, 15 bp, Homo sapiens
aatccgagctacttg

SEQ ID NO: 12536 - DNA, 15 bp, Homo sapiens
atccgagctacttgg

SEQ ID NO: 12537 - DNA, 15 bp, Homo sapiens
tccgagctacttggg

SEQ ID NO: 12538 - DNA, 15 bp, Homo sapiens
ccgagctacttggga

SEQ ID NO: 12539 - DNA, 15 bp, Homo sapiens
cgagctacttgggag

SEQ ID NO: 12540 - DNA, 15 bp, Homo sapiens
gagctacttgggagg

SEQ ID NO: 12541 - DNA, 15 bp, Homo sapiens
tacttgggaggctgt

SEQ ID NO: 12542 - DNA, 15 bp, Homo sapiens
acttgggaggctgtg

SEQ ID NO: 12543 - DNA, 15 bp, Homo sapiens
cttgggaggctgtgg

SEQ ID NO: 12544 - DNA, 15 bp, Homo sapiens
ttgggaggctgtggc

SEQ ID NO: 12545 - DNA, 15 bp, Homo sapiens
tgggaggctgtggca

SEQ ID NO: 12546 - DNA, 15 bp, Homo sapiens
gggaggctgtggcag

SEQ ID NO: 12547 - DNA, 15 bp, Homo sapiens
ggaggctgtggcagg

SEQ ID NO: 12548 - DNA, 15 bp, Homo sapiens
aggctgtggcaggaa

SEQ ID NO: 12549 - DNA, 15 bp, Homo sapiens
ggctgtggcaggaaa

SEQ ID NO: 12550 - DNA, 15 bp, Homo sapiens
gctgtggcaggaaaa

SEQ ID NO: 12551 - DNA, 15 bp, Homo sapiens
ctgtggcaggaaaat

SEQ ID NO: 12552 - DNA, 15 bp, Homo sapiens
tgtggcaggaaaatt

SEQ ID NO: 12553 - DNA, 15 bp, Homo sapiens
gtggcaggaaaattg

SEQ ID NO: 12554 - DNA, 15 bp, Homo sapiens
tggcaggaaaattgc

SEQ ID NO: 12555 - DNA, 15 bp, Homo sapiens
ggcaggaaaattgct

SEQ ID NO: 12556 - DNA, 15 bp, Homo sapiens
gcaggaaaattgctt

SEQ ID NO: 12557 - DNA, 15 bp, Homo sapiens
caggaaaattgcttt

SEQ ID NO: 12558 - DNA, 15 bp, Homo sapiens
aggaaaattgcttta

SEQ ID NO: 12559 - DNA, 15 bp, Homo sapiens
ggaaaattgctttaa

SEQ ID NO: 12560 - DNA, 15 bp, Homo sapiens
gaaaattgctttaat

SEQ ID NO: 12561 - DNA, 15 bp, Homo sapiens
aaaattgctttaatc

SEQ ID NO: 12562 - DNA, 15 bp, Homo sapiens
aaattgctttaatct

SEQ ID NO: 12563 - DNA, 15 bp, Homo sapiens
aattgctttaatctg

SEQ ID NO: 12564 - DNA, 15 bp, Homo sapiens
attgctttaatctgg

SEQ ID NO: 12565 - DNA, 15 bp, Homo sapiens
ttgctttaatctggg

SEQ ID NO: 12566 - DNA, 15 bp, Homo sapiens
tgctttaatctggga

SEQ ID NO: 12567 - DNA, 15 bp, Homo sapiens
gctttaatctgggag

SEQ ID NO: 12568 - DNA, 15 bp, Homo sapiens
ctttaatctgggagg

SEQ ID NO: 12569 - DNA, 15 bp, Homo sapiens
tttaatctgggaggc

SEQ ID NO: 12570 - DNA, 15 bp, Homo sapiens
ttaatctgggaggca

SEQ ID NO: 12571 - DNA, 15 bp, Homo sapiens
taatctgggaggcag

SEQ ID NO: 12572 - DNA, 15 bp, Homo sapiens
aatctgggaggcaga

SEQ ID NO: 12573 - DNA, 15 bp, Homo sapiens
atctgggaggcagag

SEQ ID NO: 12574 - DNA, 15 bp, Homo sapiens
tctgggaggcagagg

SEQ ID NO: 12575 - DNA, 15 bp, Homo sapiens
gaggttgcagtgagt

SEQ ID NO: 12576 - DNA, 15 bp, Homo sapiens
aggttgcagtgagtt

SEQ ID NO: 12577 - DNA, 15 bp, Homo sapiens
ggttgcagtgagttg

SEQ ID NO: 12578 - DNA, 15 bp, Homo sapiens
gttgcagtgagttga

SEQ ID NO: 12579 - DNA, 15 bp, Homo sapiens
ttgcagtgagttgag

SEQ ID NO: 12580 - DNA, 15 bp, Homo sapiens
tgcagtgagttgaga

SEQ ID NO: 12581 - DNA, 15 bp, Homo sapiens
gcagtgagttgagat

SEQ ID NO: 12582 - DNA, 15 bp, Homo sapiens
cagtgagttgagatt

SEQ ID NO: 12583 - DNA, 15 bp, Homo sapiens
agtgagttgagattg

SEQ ID NO: 12584 - DNA, 15 bp, Homo sapiens
gtgagttgagattgt

SEQ ID NO: 12585 - DNA, 15 bp, Homo sapiens
tgagttgagattgtg

SEQ ID NO: 12586 - DNA, 15 bp, Homo sapiens
gagttgagattgtgc

SEQ ID NO: 12587 - DNA, 15 bp, Homo sapiens
agttgagattgtgcc

SEQ ID NO: 12588 - DNA, 15 bp, Homo sapiens
gttgagattgtgcca

SEQ ID NO: 12589 - DNA, 15 bp, Homo sapiens
ttgagattgtgccac

SEQ ID NO: 12590 - DNA, 15 bp, Homo sapiens
tgagattgtgccact

SEQ ID NO: 12591 - DNA, 15 bp, Homo sapiens
gccactgcactccac

SEQ ID NO: 12592 - DNA, 15 bp, Homo sapiens
ccactgcactccacc

SEQ ID NO: 12593 - DNA, 15 bp, Homo sapiens
cactgcactccaccc

SEQ ID NO: 12594 - DNA, 15 bp, Homo sapiens
actgcactccaccct

SEQ ID NO: 12595 - DNA, 15 bp, Homo sapiens
ctgcactccaccctt

SEQ ID NO: 12596 - DNA, 15 bp, Homo sapiens
tgcactccacccttg

SEQ ID NO: 12597 - DNA, 15 bp, Homo sapiens
gcactccacccttgg

SEQ ID NO: 12598 - DNA, 15 bp, Homo sapiens
cactccacccttggt

SEQ ID NO: 12599 - DNA, 15 bp, Homo sapiens
actccacccttggtg

SEQ ID NO: 12600 - DNA, 15 bp, Homo sapiens
ctccacccttggtga

SEQ ID NO: 12601 - DNA, 15 bp, Homo sapiens
tccacccttggtgac

SEQ ID NO: 12602 - DNA, 15 bp, Homo sapiens
ccacccttggtgaca

SEQ ID NO: 12603 - DNA, 15 bp, Homo sapiens
cacccttggtgacag

SEQ ID NO: 12604 - DNA, 15 bp, Homo sapiens
acccttggtgacaga

SEQ ID NO: 12605 - DNA, 15 bp, Homo sapiens
cccttggtgacagag

SEQ ID NO: 12606 - DNA, 15 bp, Homo sapiens
ccttggtgacagagt

SEQ ID NO: 12607 - DNA, 15 bp, Homo sapiens
cttggtgacagagtg

SEQ ID NO: 12608 - DNA, 15 bp, Homo sapiens
ttggtgacagagtga

SEQ ID NO: 12609 - DNA, 15 bp, Homo sapiens
gtgacagagtgagat

SEQ ID NO: 12610 - DNA, 15 bp, Homo sapiens
tgacagagtgagatt

SEQ ID NO: 12611 - DNA, 15 bp, Homo sapiens
gacagagtgagattc

SEQ ID NO: 12612 - DNA, 15 bp, Homo sapiens
acagagtgagattcc

SEQ ID NO: 12613 - DNA, 15 bp, Homo sapiens
cagagtgagattcca

SEQ ID NO: 12614 - DNA, 15 bp, Homo sapiens
agagtgagattccat

SEQ ID NO: 12615 - DNA, 15 bp, Homo sapiens
gagtgagattccatc

SEQ ID NO: 12616 - DNA, 15 bp, Homo sapiens
agtgagattccatct

SEQ ID NO: 12617 - DNA, 15 bp, Homo sapiens
gtgagattccatctc

SEQ ID NO: 12618 - DNA, 15 bp, Homo sapiens
tgagattccatctca

SEQ ID NO: 12619 - DNA, 15 bp, Homo sapiens
gagattccatctcaa

SEQ ID NO: 12620 - DNA, 15 bp, Homo sapiens
agattccatctcaaa

SEQ ID NO: 12621 - DNA, 15 bp, Homo sapiens
gattccatctcaaaa

SEQ ID NO: 12622 - DNA, 15 bp, Homo sapiens
ccatctcaaaaaaag

SEQ ID NO: 12623 - DNA, 15 bp, Homo sapiens
catctcaaaaaaaga

SEQ ID NO: 12624 - DNA, 15 bp, Homo sapiens
atctcaaaaaaagaa

SEQ ID NO: 12625 - DNA, 15 bp, Homo sapiens
tctcaaaaaaagaaa

SEQ ID NO: 12626 - DNA, 15 bp, Homo sapiens
ctcaaaaaaagaaaa

SEQ ID NO: 12627 - DNA, 15 bp, Homo sapiens
tcaaaaaaagaaaaa

SEQ ID NO: 12628 - DNA, 15 bp, Homo sapiens
caaaaaaagaaaaag

SEQ ID NO: 12629 - DNA, 15 bp, Homo sapiens
aaaaaaagaaaaagg

SEQ ID NO: 12630 - DNA, 15 bp, Homo sapiens
aaaaaagaaaaaggc

SEQ ID NO: 12631 - DNA, 15 bp, Homo sapiens
aaaaagaaaaaggcc

SEQ ID NO: 12632 - DNA, 15 bp, Homo sapiens
aaaagaaaaaggcct

SEQ ID NO: 12633 - DNA, 15 bp, Homo sapiens
aaagaaaaaggcctg

SEQ ID NO: 12634 - DNA, 15 bp, Homo sapiens
aagaaaaaggcctgg

SEQ ID NO: 12635 - DNA, 15 bp, Homo sapiens
agaaaaaggcctggc

SEQ ID NO: 12636 - DNA, 15 bp, Homo sapiens
gaaaaaggcctggca

SEQ ID NO: 12637 - DNA, 15 bp, Homo sapiens
aaaaaggcctggcac

SEQ ID NO: 12638 - DNA, 15 bp, Homo sapiens
aaaaggcctggcacg

SEQ ID NO: 12639 - DNA, 15 bp, Homo sapiens
aaaggcctggcacgg

SEQ ID NO: 12640 - DNA, 15 bp, Homo sapiens
aaggcctggcacggt

SEQ ID NO: 12641 - DNA, 15 bp, Homo sapiens
aggcctggcacggtg

SEQ ID NO: 12642 - DNA, 15 bp, Homo sapiens
ggcctggcacggtgg

SEQ ID NO: 12643 - DNA, 15 bp, Homo sapiens
gcctggcacggtggc

SEQ ID NO: 12644 - DNA, 15 bp, Homo sapiens
cctggcacggtggct

SEQ ID NO: 12645 - DNA, 15 bp, Homo sapiens
ctggcacggtggctc

SEQ ID NO: 12646 - DNA, 15 bp, Homo sapiens
tggcacggtggctca

SEQ ID NO: 12647 - DNA, 15 bp, Homo sapiens
ggcacggtggctcac

SEQ ID NO: 12648 - DNA, 15 bp, Homo sapiens
gcacggtggctcaca

SEQ ID NO: 12649 - DNA, 15 bp, Homo sapiens
cacggtggctcacac

SEQ ID NO: 12650 - DNA, 15 bp, Homo sapiens
acggtggctcacacc

SEQ ID NO: 12651 - DNA, 15 bp, Homo sapiens
cggtggctcacacct

SEQ ID NO: 12652 - DNA, 15 bp, Homo sapiens
ggtggctcacaccta

SEQ ID NO: 12653 - DNA, 15 bp, Homo sapiens
gtggctcacacctat

SEQ ID NO: 12654 - DNA, 15 bp, Homo sapiens
tggctcacacctata

SEQ ID NO: 12655 - DNA, 15 bp, Homo sapiens
ggctcacacctataa

SEQ ID NO: 12656 - DNA, 15 bp, Homo sapiens
gctcacacctataat

SEQ ID NO: 12657 - DNA, 15 bp, Homo sapiens
ctcacacctataatc

SEQ ID NO: 12658 - DNA, 15 bp, Homo sapiens
tcacacctataatcc

SEQ ID NO: 12659 - DNA, 15 bp, Homo sapiens
cacacctataatccc

SEQ ID NO: 12660 - DNA, 15 bp, Homo sapiens
acctataatcccagt

SEQ ID NO: 12661 - DNA, 15 bp, Homo sapiens
cctataatcccagta

SEQ ID NO: 12662 - DNA, 15 bp, Homo sapiens
ctataatcccagtac

SEQ ID NO: 12663 - DNA, 15 bp, Homo sapiens
tataatcccagtact

SEQ ID NO: 12664 - DNA, 15 bp, Homo sapiens
ataatcccagtactt

SEQ ID NO: 12665 - DNA, 15 bp, Homo sapiens
agtactttgggaggt

SEQ ID NO: 12666 - DNA, 15 bp, Homo sapiens
gtactttgggaggta

SEQ ID NO: 12667 - DNA, 15 bp, Homo sapiens
tactttgggaggtag

SEQ ID NO: 12668 - DNA, 15 bp, Homo sapiens
actttgggaggtaga

SEQ ID NO: 12669 - DNA, 15 bp, Homo sapiens
ctttgggaggtagag

SEQ ID NO: 12670 - DNA, 15 bp, Homo sapiens
tttgggaggtagagg

SEQ ID NO: 12671 - DNA, 15 bp, Homo sapiens
ttgggaggtagaggc

SEQ ID NO: 12672 - DNA, 15 bp, Homo sapiens
tgggaggtagaggca

SEQ ID NO: 12673 - DNA, 15 bp, Homo sapiens
gggaggtagaggcag

SEQ ID NO: 12674 - DNA, 15 bp, Homo sapiens
ggaggtagaggcagg

SEQ ID NO: 12675 - DNA, 15 bp, Homo sapiens
gaggtagaggcaggt

SEQ ID NO: 12676 - DNA, 15 bp, Homo sapiens
aggtagaggcaggtg

SEQ ID NO: 12677 - DNA, 15 bp, Homo sapiens
ggtagaggcaggtgg

SEQ ID NO: 12678 - DNA, 15 bp, Homo sapiens
gtagaggcaggtgga

SEQ ID NO: 12679 - DNA, 15 bp, Homo sapiens
tagaggcaggtggat

SEQ ID NO: 12680 - DNA, 15 bp, Homo sapiens
agaggcaggtggatc

SEQ ID NO: 12681 - DNA, 15 bp, Homo sapiens
gaggcaggtggatca

SEQ ID NO: 12682 - DNA, 15 bp, Homo sapiens
aggcaggtggatcac

SEQ ID NO: 12683 - DNA, 15 bp, Homo sapiens
ggcaggtggatcact

SEQ ID NO: 12684 - DNA, 15 bp, Homo sapiens
gcaggtggatcactt

SEQ ID NO: 12685 - DNA, 15 bp, Homo sapiens
caggtggatcacttg

SEQ ID NO: 12686 - DNA, 15 bp, Homo sapiens
aggtggatcacttga

SEQ ID NO: 12687 - DNA, 15 bp, Homo sapiens
ggtggatcacttgag

SEQ ID NO: 12688 - DNA, 15 bp, Homo sapiens
gtggatcacttgagg

SEQ ID NO: 12689 - DNA, 15 bp, Homo sapiens
tggatcacttgaggt

SEQ ID NO: 12690 - DNA, 15 bp, Homo sapiens
ggatcacttgaggtt

SEQ ID NO: 12691 - DNA, 15 bp, Homo sapiens
gatcacttgaggtta

SEQ ID NO: 12692 - DNA, 15 bp, Homo sapiens
atcacttgaggttag

SEQ ID NO: 12693 - DNA, 15 bp, Homo sapiens
tcacttgaggttagg

SEQ ID NO: 12694 - DNA, 15 bp, Homo sapiens
cacttgaggttagga

SEQ ID NO: 12695 - DNA, 15 bp, Homo sapiens
acttgaggttaggag

SEQ ID NO: 12696 - DNA, 15 bp, Homo sapiens
cttgaggttaggagt

SEQ ID NO: 12697 - DNA, 15 bp, Homo sapiens
ttgaggttaggagtt

SEQ ID NO: 12698 - DNA, 15 bp, Homo sapiens
tgaggttaggagttc

SEQ ID NO: 12699 - DNA, 15 bp, Homo sapiens
gaggttaggagttca

SEQ ID NO: 12700 - DNA, 15 bp, Homo sapiens
aggttaggagttcag

SEQ ID NO: 12701 - DNA, 15 bp, Homo sapiens
ggttaggagttcagg

SEQ ID NO: 12702 - DNA, 15 bp, Homo sapiens
gttaggagttcagga

SEQ ID NO: 12703 - DNA, 15 bp, Homo sapiens
ttaggagttcaggac

SEQ ID NO: 12704 - DNA, 15 bp, Homo sapiens
taggagttcaggacc

SEQ ID NO: 12705 - DNA, 15 bp, Homo sapiens
aggagttcaggacca

SEQ ID NO: 12706 - DNA, 15 bp, Homo sapiens
ggagttcaggaccag

SEQ ID NO: 12707 - DNA, 15 bp, Homo sapiens
gagttcaggaccagc

SEQ ID NO: 12708 - DNA, 15 bp, Homo sapiens
agttcaggaccagcc

SEQ ID NO: 12709 - DNA, 15 bp, Homo sapiens
gttcaggaccagcct

SEQ ID NO: 12710 - DNA, 15 bp, Homo sapiens
ttcaggaccagcctg

SEQ ID NO: 12711 - DNA, 15 bp, Homo sapiens
tcaggaccagcctgg

SEQ ID NO: 12712 - DNA, 15 bp, Homo sapiens
caggaccagcctggc

SEQ ID NO: 12713 - DNA, 15 bp, Homo sapiens
aggaccagcctggcc

SEQ ID NO: 12714 - DNA, 15 bp, Homo sapiens
ggaccagcctggcca

SEQ ID NO: 12715 - DNA, 15 bp, Homo sapiens
ggccaacatggtgac

SEQ ID NO: 12716 - DNA, 15 bp, Homo sapiens
gccaacatggtgact

SEQ ID NO: 12717 - DNA, 15 bp, Homo sapiens
ccaacatggtgacta

SEQ ID NO: 12718 - DNA, 15 bp, Homo sapiens
caacatggtgactac

SEQ ID NO: 12719 - DNA, 15 bp, Homo sapiens
aacatggtgactact

SEQ ID NO: 12720 - DNA, 15 bp, Homo sapiens
acatggtgactactc

SEQ ID NO: 12721 - DNA, 15 bp, Homo sapiens
catggtgactactcc

SEQ ID NO: 12722 - DNA, 15 bp, Homo sapiens
atggtgactactcca

SEQ ID NO: 12723 - DNA, 15 bp, Homo sapiens
tggtgactactccat

SEQ ID NO: 12724 - DNA, 15 bp, Homo sapiens
ggtgactactccatt

SEQ ID NO: 12725 - DNA, 15 bp, Homo sapiens
gtgactactccattt

SEQ ID NO: 12726 - DNA, 15 bp, Homo sapiens
tgactactccatttc

SEQ ID NO: 12727 - DNA, 15 bp, Homo sapiens
gactactccatttct

SEQ ID NO: 12728 - DNA, 15 bp, Homo sapiens
actactccatttcta

SEQ ID NO: 12729 - DNA, 15 bp, Homo sapiens
ctactccatttctac

SEQ ID NO: 12730 - DNA, 15 bp, Homo sapiens
tactccatttctact

SEQ ID NO: 12731 - DNA, 15 bp, Homo sapiens
actccatttctacta

SEQ ID NO: 12732 - DNA, 15 bp, Homo sapiens
ctccatttctactaa

SEQ ID NO: 12733 - DNA, 15 bp, Homo sapiens
tccatttctactaaa

SEQ ID NO: 12734 - DNA, 15 bp, Homo sapiens
ccatttctactaaat

SEQ ID NO: 12735 - DNA, 15 bp, Homo sapiens
catttctactaaata

SEQ ID NO: 12736 - DNA, 15 bp, Homo sapiens
atttctactaaatac

SEQ ID NO: 12737 - DNA, 15 bp, Homo sapiens
tttctactaaataca

SEQ ID NO: 12738 - DNA, 15 bp, Homo sapiens
ttctactaaatacac

SEQ ID NO: 12739 - DNA, 15 bp, Homo sapiens
tctactaaatacaca

SEQ ID NO: 12740 - DNA, 15 bp, Homo sapiens
ctactaaatacacaa

SEQ ID NO: 12741 - DNA, 15 bp, Homo sapiens
tactaaatacacaaa

SEQ ID NO: 12742 - DNA, 15 bp, Homo sapiens
actaaatacacaaaa

SEQ ID NO: 12743 - DNA, 15 bp, Homo sapiens
ctaaatacacaaaac

SEQ ID NO: 12744 - DNA, 15 bp, Homo sapiens
taaatacacaaaact

SEQ ID NO: 12745 - DNA, 15 bp, Homo sapiens
aaatacacaaaactt

SEQ ID NO: 12746 - DNA, 15 bp, Homo sapiens
aatacacaaaactta

SEQ ID NO: 12747 - DNA, 15 bp, Homo sapiens
atacacaaaacttag

SEQ ID NO: 12748 - DNA, 15 bp, Homo sapiens
tacacaaaacttagc

SEQ ID NO: 12749 - DNA, 15 bp, Homo sapiens
acacaaaacttagcc

SEQ ID NO: 12750 - DNA, 15 bp, Homo sapiens
cacaaaacttagccc

SEQ ID NO: 12751 - DNA, 15 bp, Homo sapiens
acaaaacttagccca

SEQ ID NO: 12752 - DNA, 15 bp, Homo sapiens
caaaacttagcccag

SEQ ID NO: 12753 - DNA, 15 bp, Homo sapiens
aaaacttagcccagt

SEQ ID NO: 12754 - DNA, 15 bp, Homo sapiens
aaacttagcccagtg

SEQ ID NO: 12755 - DNA, 15 bp, Homo sapiens
aacttagcccagtgg

SEQ ID NO: 12756 - DNA, 15 bp, Homo sapiens
acttagcccagtggc

SEQ ID NO: 12757 - DNA, 15 bp, Homo sapiens
cttagcccagtggcg

SEQ ID NO: 12758 - DNA, 15 bp, Homo sapiens
ttagcccagtggcgg

SEQ ID NO: 12759 - DNA, 15 bp, Homo sapiens
tagcccagtggcggg

SEQ ID NO: 12760 - DNA, 15 bp, Homo sapiens
agcccagtggcgggc

SEQ ID NO: 12761 - DNA, 15 bp, Homo sapiens
gcccagtggcgggca

SEQ ID NO: 12762 - DNA, 15 bp, Homo sapiens
cccagtggcgggcag

SEQ ID NO: 12763 - DNA, 15 bp, Homo sapiens
ccagtggcgggcagt

SEQ ID NO: 12764 - DNA, 15 bp, Homo sapiens
cagtggcgggcagtt

SEQ ID NO: 12765 - DNA, 15 bp, Homo sapiens
agtggcgggcagttg

SEQ ID NO: 12766 - DNA, 15 bp, Homo sapiens
gtggcgggcagttgt

SEQ ID NO: 12767 - DNA, 15 bp, Homo sapiens
tggcgggcagttgta

SEQ ID NO: 12768 - DNA, 15 bp, Homo sapiens
ggcgggcagttgtaa

SEQ ID NO: 12769 - DNA, 15 bp, Homo sapiens
gcgggcagttgtaat

SEQ ID NO: 12770 - DNA, 15 bp, Homo sapiens
cgggcagttgtaatc

SEQ ID NO: 12771 - DNA, 15 bp, Homo sapiens
gggcagttgtaatcc

SEQ ID NO: 12772 - DNA, 15 bp, Homo sapiens
ggcagttgtaatccc

SEQ ID NO: 12773 - DNA, 15 bp, Homo sapiens
gcagttgtaatccca

SEQ ID NO: 12774 - DNA, 15 bp, Homo sapiens
cagttgtaatcccag

SEQ ID NO: 12775 - DNA, 15 bp, Homo sapiens
agttgtaatcccagc

SEQ ID NO: 12776 - DNA, 15 bp, Homo sapiens
gttgtaatcccagct

SEQ ID NO: 12777 - DNA, 15 bp, Homo sapiens
ttgtaatcccagcta

SEQ ID NO: 12778 - DNA, 15 bp, Homo sapiens
atcccagctacttga

SEQ ID NO: 12779 - DNA, 15 bp, Homo sapiens
tcccagctacttgag

SEQ ID NO: 12780 - DNA, 15 bp, Homo sapiens
cccagctacttgaga

SEQ ID NO: 12781 - DNA, 15 bp, Homo sapiens
ccagctacttgagag

SEQ ID NO: 12782 - DNA, 15 bp, Homo sapiens
cagctacttgagagg

SEQ ID NO: 12783 - DNA, 15 bp, Homo sapiens
agctacttgagaggt

SEQ ID NO: 12784 - DNA, 15 bp, Homo sapiens
gctacttgagaggtt

SEQ ID NO: 12785 - DNA, 15 bp, Homo sapiens
ctacttgagaggttg

SEQ ID NO: 12786 - DNA, 15 bp, Homo sapiens
tacttgagaggttga

SEQ ID NO: 12787 - DNA, 15 bp, Homo sapiens
acttgagaggttgag

SEQ ID NO: 12788 - DNA, 15 bp, Homo sapiens
cttgagaggttgagg

SEQ ID NO: 12789 - DNA, 15 bp, Homo sapiens
ttgagaggttgaggc

SEQ ID NO: 12790 - DNA, 15 bp, Homo sapiens
tgagaggttgaggca

SEQ ID NO: 12791 - DNA, 15 bp, Homo sapiens
gagaggttgaggcag

SEQ ID NO: 12792 - DNA, 15 bp, Homo sapiens
agaggttgaggcagg

SEQ ID NO: 12793 - DNA, 15 bp, Homo sapiens
gaggttgaggcagga

SEQ ID NO: 12794 - DNA, 15 bp, Homo sapiens
aggttgaggcaggag

SEQ ID NO: 12795 - DNA, 15 bp, Homo sapiens
ggttgaggcaggaga

SEQ ID NO: 12796 - DNA, 15 bp, Homo sapiens
gttgaggcaggagaa

SEQ ID NO: 12797 - DNA, 15 bp, Homo sapiens
ttgaggcaggagaat

SEQ ID NO: 12798 - DNA, 15 bp, Homo sapiens
cacttgaacctggga

SEQ ID NO: 12799 - DNA, 15 bp, Homo sapiens
acttgaacctgggag

SEQ ID NO: 12800 - DNA, 15 bp, Homo sapiens
gccgagatcacaccg

SEQ ID NO: 12801 - DNA, 15 bp, Homo sapiens
ccgagatcacaccgc

SEQ ID NO: 12802 - DNA, 15 bp, Homo sapiens
cgagatcacaccgct

SEQ ID NO: 12803 - DNA, 15 bp, Homo sapiens
gagatcacaccgctg

SEQ ID NO: 12804 - DNA, 15 bp, Homo sapiens
agatcacaccgctgc

SEQ ID NO: 12805 - DNA, 15 bp, Homo sapiens
gatcacaccgctgca

SEQ ID NO: 12806 - DNA, 15 bp, Homo sapiens
atcacaccgctgcac

SEQ ID NO: 12807 - DNA, 15 bp, Homo sapiens
tcacaccgctgcact

SEQ ID NO: 12808 - DNA, 15 bp, Homo sapiens
cacaccgctgcactc

SEQ ID NO: 12809 - DNA, 15 bp, Homo sapiens
acaccgctgcactct

SEQ ID NO: 12810 - DNA, 15 bp, Homo sapiens
caccgctgcactcta

SEQ ID NO: 12811 - DNA, 15 bp, Homo sapiens
accgctgcactctag

SEQ ID NO: 12812 - DNA, 15 bp, Homo sapiens
ccgctgcactctagc

SEQ ID NO: 12813 - DNA, 15 bp, Homo sapiens
cgctgcactctagcc

SEQ ID NO: 12814 - DNA, 15 bp, Homo sapiens
gctgcactctagcct

SEQ ID NO: 12815 - DNA, 15 bp, Homo sapiens
tgcactctagcctgg

SEQ ID NO: 12816 - DNA, 15 bp, Homo sapiens
gcactctagcctggc

SEQ ID NO: 12817 - DNA, 15 bp, Homo sapiens
cactctagcctggcc

SEQ ID NO: 12818 - DNA, 15 bp, Homo sapiens
actctagcctggcca

SEQ ID NO: 12819 - DNA, 15 bp, Homo sapiens
ctctagcctggccaa

SEQ ID NO: 12820 - DNA, 15 bp, Homo sapiens
tctagcctggccaac

SEQ ID NO: 12821 - DNA, 15 bp, Homo sapiens
ctagcctggccaaca

SEQ ID NO: 12822 - DNA, 15 bp, Homo sapiens
tagcctggccaacag

SEQ ID NO: 12823 - DNA, 15 bp, Homo sapiens
agcctggccaacaga

SEQ ID NO: 12824 - DNA, 15 bp, Homo sapiens
gcctggccaacagag

SEQ ID NO: 12825 - DNA, 15 bp, Homo sapiens
cctggccaacagagt

SEQ ID NO: 12826 - DNA, 15 bp, Homo sapiens
ctggccaacagagtg

SEQ ID NO: 12827 - DNA, 15 bp, Homo sapiens
tggccaacagagtga

SEQ ID NO: 12828 - DNA, 15 bp, Homo sapiens
ggccaacagagtgag

SEQ ID NO: 12829 - DNA, 15 bp, Homo sapiens
gccaacagagtgaga

SEQ ID NO: 12830 - DNA, 15 bp, Homo sapiens
ccaacagagtgagaa

SEQ ID NO: 12831 - DNA, 15 bp, Homo sapiens
caacagagtgagaat

SEQ ID NO: 12832 - DNA, 15 bp, Homo sapiens
aacagagtgagaatt

SEQ ID NO: 12833 - DNA, 15 bp, Homo sapiens
acagagtgagaattt

SEQ ID NO: 12834 - DNA, 15 bp, Homo sapiens
cagagtgagaatttg

SEQ ID NO: 12835 - DNA, 15 bp, Homo sapiens
agagtgagaatttgc

SEQ ID NO: 12836 - DNA, 15 bp, Homo sapiens
gagtgagaatttgcg

SEQ ID NO: 12837 - DNA, 15 bp, Homo sapiens
agtgagaatttgcgg

SEQ ID NO: 12838 - DNA, 15 bp, Homo sapiens
gtgagaatttgcgga

SEQ ID NO: 12839 - DNA, 15 bp, Homo sapiens
tgagaatttgcggag

SEQ ID NO: 12840 - DNA, 15 bp, Homo sapiens
gagaatttgcggagg

SEQ ID NO: 12841 - DNA, 15 bp, Homo sapiens
agaatttgcggaggg

SEQ ID NO: 12842 - DNA, 15 bp, Homo sapiens
gaatttgcggaggga

SEQ ID NO: 12843 - DNA, 15 bp, Homo sapiens
aatttgcggagggaa

SEQ ID NO: 12844 - DNA, 15 bp, Homo sapiens
atttgcggagggaaa

SEQ ID NO: 12845 - DNA, 15 bp, Homo sapiens
tttgcggagggaaaa

SEQ ID NO: 12846 - DNA, 15 bp, Homo sapiens
ttgcggagggaaaaa

SEQ ID NO: 12847 - DNA, 15 bp, Homo sapiens
tgcggagggaaaaaa

SEQ ID NO: 12848 - DNA, 15 bp, Homo sapiens
gcggagggaaaaaaa

SEQ ID NO: 12849 - DNA, 15 bp, Homo sapiens
cggagggaaaaaaaa

SEQ ID NO: 12850 - DNA, 15 bp, Homo sapiens
ggagggaaaaaaaag

SEQ ID NO: 12851 - DNA, 15 bp, Homo sapiens
gagggaaaaaaaagt

SEQ ID NO: 12852 - DNA, 15 bp, Homo sapiens
agggaaaaaaaagtc

SEQ ID NO: 12853 - DNA, 15 bp, Homo sapiens
gggaaaaaaaagtca

SEQ ID NO: 12854 - DNA, 15 bp, Homo sapiens
ggaaaaaaaagtcac

SEQ ID NO: 12855 - DNA, 15 bp, Homo sapiens
gaaaaaaaagtcacg

SEQ ID NO: 12856 - DNA, 15 bp, Homo sapiens
aaaaaaaagtcacgc

SEQ ID NO: 12857 - DNA, 15 bp, Homo sapiens
aaaaaaagtcacgct

SEQ ID NO: 12858 - DNA, 15 bp, Homo sapiens
aaaaaagtcacgctt

SEQ ID NO: 12859 - DNA, 15 bp, Homo sapiens
aaaaagtcacgcttc

SEQ ID NO: 12860 - DNA, 15 bp, Homo sapiens
aaaagtcacgcttca

SEQ ID NO: 12861 - DNA, 15 bp, Homo sapiens
aaagtcacgcttcag

SEQ ID NO: 12862 - DNA, 15 bp, Homo sapiens
aagtcacgcttcagt

SEQ ID NO: 12863 - DNA, 15 bp, Homo sapiens
agtcacgcttcagtt

SEQ ID NO: 12864 - DNA, 15 bp, Homo sapiens
gtcacgcttcagttg

SEQ ID NO: 12865 - DNA, 15 bp, Homo sapiens
tcacgcttcagttgt

SEQ ID NO: 12866 - DNA, 15 bp, Homo sapiens
cacgcttcagttgtt

SEQ ID NO: 12867 - DNA, 15 bp, Homo sapiens
acgcttcagttgttg

SEQ ID NO: 12868 - DNA, 15 bp, Homo sapiens
cgcttcagttgttgt

SEQ ID NO: 12869 - DNA, 15 bp, Homo sapiens
gcttcagttgttgta

SEQ ID NO: 12870 - DNA, 15 bp, Homo sapiens
cttcagttgttgtag

SEQ ID NO: 12871 - DNA, 15 bp, Homo sapiens
ttcagttgttgtagt

SEQ ID NO: 12872 - DNA, 15 bp, Homo sapiens
tcagttgttgtagta

SEQ ID NO: 12873 - DNA, 15 bp, Homo sapiens
cagttgttgtagtat

SEQ ID NO: 12874 - DNA, 15 bp, Homo sapiens
agttgttgtagtata

SEQ ID NO: 12875 - DNA, 15 bp, Homo sapiens
gttgttgtagtataa

SEQ ID NO: 12876 - DNA, 15 bp, Homo sapiens
ttgttgtagtataac

SEQ ID NO: 12877 - DNA, 15 bp, Homo sapiens
tgttgtagtataacc

SEQ ID NO: 12878 - DNA, 15 bp, Homo sapiens
gttgtagtataacct

SEQ ID NO: 12879 - DNA, 15 bp, Homo sapiens
ttgtagtataacctt

SEQ ID NO: 12880 - DNA, 15 bp, Homo sapiens
tgtagtataaccttg

SEQ ID NO: 12881 - DNA, 15 bp, Homo sapiens
gtagtataaccttgg

SEQ ID NO: 12882 - DNA, 15 bp, Homo sapiens
tagtataaccttggt

SEQ ID NO: 12883 - DNA, 15 bp, Homo sapiens
agtataaccttggta

SEQ ID NO: 12884 - DNA, 15 bp, Homo sapiens
gtataaccttggtat

SEQ ID NO: 12885 - DNA, 15 bp, Homo sapiens
tataaccttggtata

SEQ ID NO: 12886 - DNA, 15 bp, Homo sapiens
ataaccttggtatat

SEQ ID NO: 12887 - DNA, 15 bp, Homo sapiens
taaccttggtatatt

SEQ ID NO: 12888 - DNA, 15 bp, Homo sapiens
aaccttggtatattg

SEQ ID NO: 12889 - DNA, 15 bp, Homo sapiens
accttggtatattgt

SEQ ID NO: 12890 - DNA, 15 bp, Homo sapiens
ccttggtatattgta

SEQ ID NO: 12891 - DNA, 15 bp, Homo sapiens
cttggtatattgtat

SEQ ID NO: 12892 - DNA, 15 bp, Homo sapiens
ttggtatattgtatg

SEQ ID NO: 12893 - DNA, 15 bp, Homo sapiens
tggtatattgtatgt

SEQ ID NO: 12894 - DNA, 15 bp, Homo sapiens
ggtatattgtatgta

SEQ ID NO: 12895 - DNA, 15 bp, Homo sapiens
gtatattgtatgtat

SEQ ID NO: 12896 - DNA, 15 bp, Homo sapiens
tatattgtatgtatc

SEQ ID NO: 12897 - DNA, 15 bp, Homo sapiens
atattgtatgtatca

SEQ ID NO: 12898 - DNA, 15 bp, Homo sapiens
tattgtatgtatcat

SEQ ID NO: 12899 - DNA, 15 bp, Homo sapiens
attgtatgtatcatg

SEQ ID NO: 12900 - DNA, 15 bp, Homo sapiens
ttgtatgtatcatga

SEQ ID NO: 12901 - DNA, 15 bp, Homo sapiens
tgtatgtatcatgaa

SEQ ID NO: 12902 - DNA, 15 bp, Homo sapiens
gtatgtatcatgaat

SEQ ID NO: 12903 - DNA, 15 bp, Homo sapiens
tatgtatcatgaatt

SEQ ID NO: 12904 - DNA, 15 bp, Homo sapiens
atgtatcatgaattc

SEQ ID NO: 12905 - DNA, 15 bp, Homo sapiens
tgtatcatgaattcc

SEQ ID NO: 12906 - DNA, 15 bp, Homo sapiens
gtatcatgaattcct

SEQ ID NO: 12907 - DNA, 15 bp, Homo sapiens
tatcatgaattcctc

SEQ ID NO: 12908 - DNA, 15 bp, Homo sapiens
atcatgaattcctca

SEQ ID NO: 12909 - DNA, 15 bp, Homo sapiens
tcatgaattcctcat

SEQ ID NO: 12910 - DNA, 15 bp, Homo sapiens
catgaattcctcatt

SEQ ID NO: 12911 - DNA, 15 bp, Homo sapiens
atgaattcctcattt

SEQ ID NO: 12912 - DNA, 15 bp, Homo sapiens
tgaattcctcatttt

SEQ ID NO: 12913 - DNA, 15 bp, Homo sapiens
gaattcctcatttta

SEQ ID NO: 12914 - DNA, 15 bp, Homo sapiens
aattcctcattttaa

SEQ ID NO: 12915 - DNA, 15 bp, Homo sapiens
attcctcattttaat

SEQ ID NO: 12916 - DNA, 15 bp, Homo sapiens
ttcctcattttaatg

SEQ ID NO: 12917 - DNA, 15 bp, Homo sapiens
tcctcattttaatga

SEQ ID NO: 12918 - DNA, 15 bp, Homo sapiens
cctcattttaatgac

SEQ ID NO: 12919 - DNA, 15 bp, Homo sapiens
ctcattttaatgacc

SEQ ID NO: 12920 - DNA, 15 bp, Homo sapiens
tcattttaatgacca

SEQ ID NO: 12921 - DNA, 15 bp, Homo sapiens
cattttaatgaccaa

SEQ ID NO: 12922 - DNA, 15 bp, Homo sapiens
attttaatgaccaaa

SEQ ID NO: 12923 - DNA, 15 bp, Homo sapiens
ttttaatgaccaaaa

SEQ ID NO: 12924 - DNA, 15 bp, Homo sapiens
tttaatgaccaaaaa

SEQ ID NO: 12925 - DNA, 15 bp, Homo sapiens
ttaatgaccaaaaag

SEQ ID NO: 12926 - DNA, 15 bp, Homo sapiens
taatgaccaaaaagt

SEQ ID NO: 12927 - DNA, 15 bp, Homo sapiens
aatgaccaaaaagta

SEQ ID NO: 12928 - DNA, 15 bp, Homo sapiens
atgaccaaaaagtaa

SEQ ID NO: 12929 - DNA, 15 bp, Homo sapiens
tgaccaaaaagtaat

SEQ ID NO: 12930 - DNA, 15 bp, Homo sapiens
gaccaaaaagtaata

SEQ ID NO: 12931 - DNA, 15 bp, Homo sapiens
accaaaaagtaataa

SEQ ID NO: 12932 - DNA, 15 bp, Homo sapiens
ccaaaaagtaataaa

SEQ ID NO: 12933 - DNA, 15 bp, Homo sapiens
caaaaagtaataaat

SEQ ID NO: 12934 - DNA, 15 bp, Homo sapiens
aaaaagtaataaatc

SEQ ID NO: 12935 - DNA, 15 bp, Homo sapiens
aaaagtaataaatca

SEQ ID NO: 12936 - DNA, 15 bp, Homo sapiens
aaagtaataaatcaa

SEQ ID NO: 12937 - DNA, 15 bp, Homo sapiens
aagtaataaatcaac

SEQ ID NO: 12938 - DNA, 15 bp, Homo sapiens
agtaataaatcaaca

SEQ ID NO: 12939 - DNA, 15 bp, Homo sapiens
gtaataaatcaacag

SEQ ID NO: 12940 - DNA, 15 bp, Homo sapiens
taataaatcaacagc

SEQ ID NO: 12941 - DNA, 15 bp, Homo sapiens
aataaatcaacagct

SEQ ID NO: 12942 - DNA, 15 bp, Homo sapiens
ataaatcaacagctt

SEQ ID NO: 12943 - DNA, 15 bp, Homo sapiens
taaatcaacagcttg

SEQ ID NO: 12944 - DNA, 15 bp, Homo sapiens
aaatcaacagcttgt

SEQ ID NO: 12945 - DNA, 15 bp, Homo sapiens
aatcaacagcttgta

SEQ ID NO: 12946 - DNA, 15 bp, Homo sapiens
atcaacagcttgtaa

SEQ ID NO: 12947 - DNA, 15 bp, Homo sapiens
tcaacagcttgtaat

SEQ ID NO: 12948 - DNA, 15 bp, Homo sapiens
caacagcttgtaatt

SEQ ID NO: 12949 - DNA, 15 bp, Homo sapiens
aacagcttgtaattt

SEQ ID NO: 12950 - DNA, 15 bp, Homo sapiens
acagcttgtaatttg

SEQ ID NO: 12951 - DNA, 15 bp, Homo sapiens
cagcttgtaatttgt

SEQ ID NO: 12952 - DNA, 15 bp, Homo sapiens
agcttgtaatttgtt

SEQ ID NO: 12953 - DNA, 15 bp, Homo sapiens
gcttgtaatttgttt

SEQ ID NO: 12954 - DNA, 15 bp, Homo sapiens
cttgtaatttgtttt

SEQ ID NO: 12955 - DNA, 15 bp, Homo sapiens
ttgtaatttgttttg

SEQ ID NO: 12956 - DNA, 15 bp, Homo sapiens
tgtaatttgttttga

SEQ ID NO: 12957 - DNA, 15 bp, Homo sapiens
gtaatttgttttgag

SEQ ID NO: 12958 - DNA, 15 bp, Homo sapiens
taatttgttttgaga

SEQ ID NO: 12959 - DNA, 15 bp, Homo sapiens
aatttgttttgagat

SEQ ID NO: 12960 - DNA, 15 bp, Homo sapiens
atttgttttgagatc

SEQ ID NO: 12961 - DNA, 15 bp, Homo sapiens
tttgttttgagatca

SEQ ID NO: 12962 - DNA, 15 bp, Homo sapiens
ttgttttgagatcag

SEQ ID NO: 12963 - DNA, 15 bp, Homo sapiens
tgttttgagatcagt

SEQ ID NO: 12964 - DNA, 15 bp, Homo sapiens
gttttgagatcagtt

SEQ ID NO: 12965 - DNA, 15 bp, Homo sapiens
ttttgagatcagtta

SEQ ID NO: 12966 - DNA, 15 bp, Homo sapiens
tttgagatcagttat

SEQ ID NO: 12967 - DNA, 15 bp, Homo sapiens
ttgagatcagttatc

SEQ ID NO: 12968 - DNA, 15 bp, Homo sapiens
tgagatcagttatct

SEQ ID NO: 12969 - DNA, 15 bp, Homo sapiens
gagatcagttatctg

SEQ ID NO: 12970 - DNA, 15 bp, Homo sapiens
agatcagttatctga

SEQ ID NO: 12971 - DNA, 15 bp, Homo sapiens
gatcagttatctgac

SEQ ID NO: 12972 - DNA, 15 bp, Homo sapiens
atcagttatctgact

SEQ ID NO: 12973 - DNA, 15 bp, Homo sapiens
tcagttatctgactg

SEQ ID NO: 12974 - DNA, 15 bp, Homo sapiens
cagttatctgactgt

SEQ ID NO: 12975 - DNA, 15 bp, Homo sapiens
agttatctgactgta

SEQ ID NO: 12976 - DNA, 15 bp, Homo sapiens
gttatctgactgtaa

SEQ ID NO: 12977 - DNA, 15 bp, Homo sapiens
ttatctgactgtaac

SEQ ID NO: 12978 - DNA, 15 bp, Homo sapiens
tatctgactgtaaca

SEQ ID NO: 12979 - DNA, 15 bp, Homo sapiens
atctgactgtaacac

SEQ ID NO: 12980 - DNA, 15 bp, Homo sapiens
tctgactgtaacact

SEQ ID NO: 12981 - DNA, 15 bp, Homo sapiens
ctgactgtaacactg

SEQ ID NO: 12982 - DNA, 15 bp, Homo sapiens
tgactgtaacactgt

SEQ ID NO: 12983 - DNA, 15 bp, Homo sapiens
gactgtaacactgta

SEQ ID NO: 12984 - DNA, 15 bp, Homo sapiens
actgtaacactgtag

SEQ ID NO: 12985 - DNA, 15 bp, Homo sapiens
ctgtaacactgtagg

SEQ ID NO: 12986 - DNA, 15 bp, Homo sapiens
tgtaacactgtaggc

SEQ ID NO: 12987 - DNA, 15 bp, Homo sapiens
gtaacactgtaggct

SEQ ID NO: 12988 - DNA, 15 bp, Homo sapiens
taacactgtaggctt

SEQ ID NO: 12989 - DNA, 15 bp, Homo sapiens
aacactgtaggcttt

SEQ ID NO: 12990 - DNA, 15 bp, Homo sapiens
acactgtaggctttt

SEQ ID NO: 12991 - DNA, 15 bp, Homo sapiens
cactgtaggcttttg

SEQ ID NO: 12992 - DNA, 15 bp, Homo sapiens
actgtaggcttttgt

SEQ ID NO: 12993 - DNA, 15 bp, Homo sapiens
ctgtaggcttttgtg

SEQ ID NO: 12994 - DNA, 15 bp, Homo sapiens
tgtaggcttttgtgt

SEQ ID NO: 12995 - DNA, 15 bp, Homo sapiens
gtaggcttttgtgtt

SEQ ID NO: 12996 - DNA, 15 bp, Homo sapiens
taggcttttgtgttt

SEQ ID NO: 12997 - DNA, 15 bp, Homo sapiens
aggcttttgtgtttt

SEQ ID NO: 12998 - DNA, 15 bp, Homo sapiens
ggcttttgtgttttt

SEQ ID NO: 12999 - DNA, 15 bp, Homo sapiens
gcttttgtgtttttt

SEQ ID NO: 13000 - DNA, 15 bp, Homo sapiens
cttttgtgtttttta

SEQ ID NO: 13001 - DNA, 15 bp, Homo sapiens
ttttgtgttttttaa

SEQ ID NO: 13002 - DNA, 15 bp, Homo sapiens
tttgtgttttttaaa

SEQ ID NO: 13003 - DNA, 15 bp, Homo sapiens
ttgtgttttttaaat

SEQ ID NO: 13004 - DNA, 15 bp, Homo sapiens
tgtgttttttaaatt

SEQ ID NO: 13005 - DNA, 15 bp, Homo sapiens
gtgttttttaaatta

SEQ ID NO: 13006 - DNA, 15 bp, Homo sapiens
tgttttttaaattat

SEQ ID NO: 13007 - DNA, 15 bp, Homo sapiens
gttttttaaattatg

SEQ ID NO: 13008 - DNA, 15 bp, Homo sapiens
ttttttaaattatga

SEQ ID NO: 13009 - DNA, 15 bp, Homo sapiens
tttttaaattatgaa

SEQ ID NO: 13010 - DNA, 15 bp, Homo sapiens
ttttaaattatgaaa

SEQ ID NO: 13011 - DNA, 15 bp, Homo sapiens
tttaaattatgaaat

SEQ ID NO: 13012 - DNA, 15 bp, Homo sapiens
ttaaattatgaaata

SEQ ID NO: 13013 - DNA, 15 bp, Homo sapiens
taaattatgaaatat

SEQ ID NO: 13014 - DNA, 15 bp, Homo sapiens
aaattatgaaatatt

SEQ ID NO: 13015 - DNA, 15 bp, Homo sapiens
aattatgaaatattt

SEQ ID NO: 13016 - DNA, 15 bp, Homo sapiens
attatgaaatatttg

SEQ ID NO: 13017 - DNA, 15 bp, Homo sapiens
aactcctgacctcaa

SEQ ID NO: 13018 - DNA, 15 bp, Homo sapiens
actcctgacctcaag

SEQ ID NO: 13019 - DNA, 15 bp, Homo sapiens
ctcctgacctcaagt

SEQ ID NO: 13020 - DNA, 15 bp, Homo sapiens
atgtaccctcttaga

SEQ ID NO: 13021 - DNA, 15 bp, Homo sapiens
tgtaccctcttagaa

SEQ ID NO: 13022 - DNA, 15 bp, Homo sapiens
gtaccctcttagaat

SEQ ID NO: 13023 - DNA, 15 bp, Homo sapiens
taccctcttagaata

SEQ ID NO: 13024 - DNA, 15 bp, Homo sapiens
accctcttagaatat

SEQ ID NO: 13025 - DNA, 15 bp, Homo sapiens
ccctcttagaatata

SEQ ID NO: 13026 - DNA, 15 bp, Homo sapiens
cctcttagaatatat

SEQ ID NO: 13027 - DNA, 15 bp, Homo sapiens
ctcttagaatatata

SEQ ID NO: 13028 - DNA, 15 bp, Homo sapiens
tcttagaatatatac

SEQ ID NO: 13029 - DNA, 15 bp, Homo sapiens
cttagaatatataca

SEQ ID NO: 13030 - DNA, 15 bp, Homo sapiens
ttagaatatatacat

SEQ ID NO: 13031 - DNA, 15 bp, Homo sapiens
tagaatatatacatc

SEQ ID NO: 13032 - DNA, 15 bp, Homo sapiens
agaatatatacatca

SEQ ID NO: 13033 - DNA, 15 bp, Homo sapiens
gaatatatacatcat

SEQ ID NO: 13034 - DNA, 15 bp, Homo sapiens
aatatatacatcatg

SEQ ID NO: 13035 - DNA, 15 bp, Homo sapiens
ctggagtgcagtggt

SEQ ID NO: 13036 - DNA, 15 bp, Homo sapiens
tggagtgcagtggtg

SEQ ID NO: 13037 - DNA, 15 bp, Homo sapiens
agcaagctctgcctc

SEQ ID NO: 13038 - DNA, 15 bp, Homo sapiens
caagctctgcctcct

SEQ ID NO: 13039 - DNA, 15 bp, Homo sapiens
aagctctgcctcctg

SEQ ID NO: 13040 - DNA, 15 bp, Homo sapiens
agctctgcctcctgg

SEQ ID NO: 13041 - DNA, 15 bp, Homo sapiens
gctctgcctcctgga

SEQ ID NO: 13042 - DNA, 15 bp, Homo sapiens
ctctgcctcctggat

SEQ ID NO: 13043 - DNA, 15 bp, Homo sapiens
tctgcctcctggatt

SEQ ID NO: 13044 - DNA, 15 bp, Homo sapiens
ctgcctcctggattc

SEQ ID NO: 13045 - DNA, 15 bp, Homo sapiens
tgcctcctggattca

SEQ ID NO: 13046 - DNA, 15 bp, Homo sapiens
gcctcctggattcac

SEQ ID NO: 13047 - DNA, 15 bp, Homo sapiens
cctcctggattcacg

SEQ ID NO: 13048 - DNA, 15 bp, Homo sapiens
ctcctggattcacgc

SEQ ID NO: 13049 - DNA, 15 bp, Homo sapiens
tcctggattcacgcc

SEQ ID NO: 13050 - DNA, 15 bp, Homo sapiens
cctggattcacgcca

SEQ ID NO: 13051 - DNA, 15 bp, Homo sapiens
tttattttttttttt

SEQ ID NO: 13052 - DNA, 15 bp, Homo sapiens
ttatttttttttttt

SEQ ID NO: 13053 - DNA, 15 bp, Homo sapiens
tattttttttttttt

SEQ ID NO: 13054 - DNA, 15 bp, Homo sapiens
ttcaccgtggtctcg

SEQ ID NO: 13055 - DNA, 15 bp, Homo sapiens
tcaccgtggtctcga

SEQ ID NO: 13056 - DNA, 15 bp, Homo sapiens
caccgtggtctcgat

SEQ ID NO: 13057 - DNA, 15 bp, Homo sapiens
accgtggtctcgatc

SEQ ID NO: 13058 - DNA, 15 bp, Homo sapiens
ccgtggtctcgatct

SEQ ID NO: 13059 - DNA, 15 bp, Homo sapiens
cgtggtctcgatctc

SEQ ID NO: 13060 - DNA, 15 bp, Homo sapiens
gtggtctcgatctcc

SEQ ID NO: 13061 - DNA, 15 bp, Homo sapiens
gatctcctgacctcg

SEQ ID NO: 13062 - DNA, 20 bp, Homo sapiens
attctcttgatgatgctgat

SEQ ID NO: 13063 - DNA, 20 bp, Homo sapiens
ttctcttgatgatgctgatg

SEQ ID NO: 13064 - DNA, 20 bp, Homo sapiens
tctcttgatgatgctgatgc

SEQ ID NO: 13065 - DNA, 20 bp, Homo sapiens
ctcttgatgatgctgatgct

SEQ ID NO: 13066 - DNA, 20 bp, Homo sapiens
tcttgatgatgctgatgctt

SEQ ID NO: 13067 - DNA, 20 bp, Homo sapiens
cttgatgatgctgatgcttt

SEQ ID NO: 13068 - DNA, 20 bp, Homo sapiens
ttgatgatgctgatgctttg

SEQ ID NO: 13069 - DNA, 20 bp, Homo sapiens
tgatgatgctgatgctttgg

SEQ ID NO: 13070 - DNA, 20 bp, Homo sapiens
gatgatgctgatgctttggg

SEQ ID NO: 13071 - DNA, 20 bp, Homo sapiens
atgatgctgatgctttggga

SEQ ID NO: 13072 - DNA, 20 bp, Homo sapiens
tgatgctgatgctttgggaa

SEQ ID NO: 13073 - DNA, 20 bp, Homo sapiens
gatgctgatgctttgggaag

SEQ ID NO: 13074 - DNA, 20 bp, Homo sapiens
atgctgatgctttgggaagt

SEQ ID NO: 13075 - DNA, 20 bp, Homo sapiens
tgctgatgctttgggaagta

SEQ ID NO: 13076 - DNA, 20 bp, Homo sapiens
gctgatgctttgggaagtat

SEQ ID NO: 13077 - DNA, 20 bp, Homo sapiens
ctgatgctttgggaagtatg

SEQ ID NO: 13078 - DNA, 20 bp, Homo sapiens
tgatgctttgggaagtatgt

SEQ ID NO: 13079 - DNA, 20 bp, Homo sapiens
gatgctttgggaagtatgtt

SEQ ID NO: 13080 - DNA, 20 bp, Homo sapiens
atgctttgggaagtatgtta

SEQ ID NO: 13081 - DNA, 20 bp, Homo sapiens
tgctttgggaagtatgttaa

SEQ ID NO: 13082 - DNA, 20 bp, Homo sapiens
gctttgggaagtatgttaat

SEQ ID NO: 13083 - DNA, 20 bp, Homo sapiens
ctttgggaagtatgttaatt

SEQ ID NO: 13084 - DNA, 20 bp, Homo sapiens
tttgggaagtatgttaattt

SEQ ID NO: 13085 - DNA, 20 bp, Homo sapiens
ttgggaagtatgttaatttc

SEQ ID NO: 13086 - DNA, 20 bp, Homo sapiens
tgggaagtatgttaatttca

SEQ ID NO: 13087 - DNA, 20 bp, Homo sapiens
gggaagtatgttaatttcat

SEQ ID NO: 13088 - DNA, 18 bp, Homo sapiens
tcactttcataatgctgg

SEQ ID NO: 13089 - DNA, 15 bp, Homo sapiens
tcactttcataatgc

SEQ ID NO: 13090 - DNA, 15 bp, Homo sapiens
cactttcataatgct

SEQ ID NO: 13091 - DNA, 15 bp, Homo sapiens
actttcataatgctg

SEQ ID NO: 13092 - DNA, 15 bp, Homo sapiens
ctttcataatgctgg

SEQ ID NO: 13093 - DNA, 15 bp, Homo sapiens
cctagctactttgaa

SEQ ID NO: 13094 - DNA, 15 bp, Homo sapiens
tcctagctactttga

SEQ ID NO: 13095 - DNA, 15 bp, Homo sapiens
ctacgcgtcgacggt

SEQ ID NO: 13096 - DNA, 15 bp, Homo sapiens
ccgattcgcgcgtaa

SEQ ID NO: 13097 - DNA, 37 bp, Homo sapiens
gctttgggaagtatgtttttcactttcataatgctgg

SEQ ID NO: 13098 - DNA, 36 bp, Homo sapiens
ctttgggaagtatgtttttcactttcataatgctgg

SEQ ID NO: 13099 - DNA, 37 bp, Homo sapiens
ggtacatgagtggcttttttcactttcataatgctgg

SEQ ID NO: 13100 - DNA, 14 bp, Homo sapiens
cagcattatgaaag

SEQ ID NO: 13101 - DNA, 444 bp, Homo sapiens
gtaagtctgccagcattatgaaagtgaatcttacttttgtaaaactttatggtttgtggaaaacaaatgtttttgaacatttaaaaagttcagatgttagaaagttgaaaggttaatgtaaaacaatcaatattaaagaattttgatgccaaaactattagataaaaggttaatctacatccctactagaattctcatacttaactggttggttgtgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcag

SEQ ID NO: 13102 - DNA, 37 bp, Homo sapiens
ctttgggaagtatgttttttcactttcataatgctgg

SEQ ID NO: 13103 - DNA, 34 bp, Homo sapiens
tgatgctgatgctttttttctaaaattcaatggc

SEQ ID NO: 13104 - DNA, 34 bp, Homo sapiens
ctaaaattcaatggcttttctaaaattcaatggc

SEQ ID NO: 13105 - DNA, 34 bp, Homo sapiens
ctgttacccagatgcttttctaaaattcaatggc

SEQ ID NO: 13106 - DNA, 34 bp, Homo sapiens
cttcatagtggaacattttctaaaattcaatggc

SEQ ID NO: 13107 - DNA, 40 bp, Homo sapiens
tcactttcataatgctggtttttcactttcataatgctgg

What is claimed is:

1. A composition comprising a cell and a single stranded oligonucleotide, wherein the single stranded oligonucleotide is produced by a process comprising:
synthesizing a single stranded oligonucleotide that:
(a) has a sequence 5'-X-Y-Z, wherein X is any nucleotide, Y is a nucleotide sequence of 6 nucleotides in length that is not a seed sequence of a human microRNA, and Z is a nucleotide sequence of 1 to 8 nucleotides in length,
(b) is 100% complementary with a PRC2-associated region of an SMN gene, wherein the PRC2-associated region is a region of the SMN gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the SMN gene compared to a control sequencing reaction of products of a control RNA-immunoprecipitation assay that employs a control antibody, and
(c) is 8 to 15 nucleotides in length,
wherein, during the synthesis, at least one nucleotide incorporated into the oligonucleotide is a nucleotide analogue and/or a modified internucleotide linkage is incorporated between at least two nucleotides.

2. The composition of claim 1, wherein the oligonucleotide does not comprise three or more consecutive guanosine nucleotides.

3. The composition of claim 1, wherein the oligonucleotide does not comprise four or more consecutive guanosine nucleotides.

4. The composition of claim 1, wherein the oligonucleotide is 8 to 10 nucleotides in length and all but 1, 2, or 3 of the nucleotides of the complementary sequence of the PRC2-associated region are cytosine or guanosine nucleotides.

5. The composition of claim 1, wherein at least one nucleotide of the oligonucleotide is a nucleotide analogue.

6. The composition of claim 5, wherein the at least one nucleotide analogue results in an increase in Tm of the oligonucleotide in a range of 1 to 5° C. compared with an oligonucleotide that does not have the at least one nucleotide analogue.

7. The composition of claim 1, wherein at least one nucleotide of the oligonucleotide comprises a 2' O-methyl.

8. The composition of claim 1, wherein each nucleotide of the oligonucleotide comprises a 2' O-methyl.

9. The composition of claim 1, wherein the oligonucleotide comprises at least one ribonucleotide, at least one deoxyribonucleotide, or at least one bridged nucleotide.

10. The composition of claim 9, wherein the bridged nucleotide is a LNA nucleotide, a cEt nucleotide or a ENA modified nucleotide.

11. The composition of claim 1, wherein each nucleotide of the oligonucleotide is a LNA nucleotide.

12. The composition of claim 1, wherein the nucleotides of the oligonucleotide comprise alternating deoxyribonucleotides and 2'-fluoro-deoxyribonucleotides.

13. The composition of claim 1, wherein the nucleotides of the oligonucleotide comprise alternating deoxyribonucleotides and 2'-O-methyl nucleotides.

14. The composition of claim 1, wherein the nucleotides of the oligonucleotide comprise alternating deoxyribonucleotides and ENA nucleotide analogues.

15. The composition of claim 1, wherein the nucleotides of the oligonucleotide comprise alternating deoxyribonucleotides and LNA nucleotides.

16. The composition of claim 12, wherein the 5' nucleotide of the oligonucleotide is a deoxyribonucleotide.

17. The composition of claim 1, wherein the nucleotides of the oligonucleotide comprise alternating LNA nucleotides and 2'-O-methyl nucleotides.

18. The composition of claim 17, wherein the 5' nucleotide of the oligonucleotide is a LNA nucleotide.

19. The composition of claim 1, wherein the nucleotides of the oligonucleotide comprise deoxyribonucleotides flanked by at least one LNA nucleotide on each of the 5' and 3' ends of the deoxyribonucleotides.

20. The composition of claim 1, further comprising phosphorothioate internucleotide linkages between at least two nucleotides.

21. The composition of claim 20, further comprising phosphorothioate internucleotide linkages between all nucleotides.

22. The composition of claim 1, wherein the nucleotide at the 3' position of the oligonucleotide has a 3' hydroxyl group.

23. The composition of claim 1, wherein the nucleotide at the 3' position of the oligonucleotide has a 3' thiophosphate.

24. The composition of claim 1, further comprising a biotin moiety conjugated to the 5' nucleotide.

25. A composition comprising a cell and a single stranded oligonucleotide, wherein the single stranded oligonucleotide is produced by a process comprising:
    synthesizing a single stranded oligonucleotide that:
    (a) is 100% complementary with a PRC2-associated region of an SMN gene, wherein the PRC2-associated region is a region of the SMN gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the SMN gene compared to a control sequencing reaction of products of a control RNA-immunoprecipitation assay that employs a control antibody,
    (b) is 8 to 15 nucleotides in length and has at least one of the following features i)-iv):
        i) a sequence that is 5'X-Y-Z, wherein X is any nucleotide and wherein X is anchored at the 5' end of the oligonucleotide, Y is a nucleotide sequence of 6 nucleotides in length that is not a human seed sequence of a microRNA, and Z is a nucleotide sequence of 1 to 23 nucleotides in length;
        ii) a sequence that does not comprise three or more consecutive guanosine nucleotides;
        iii) a sequence that is complementary to a PRC2-associated region that encodes an RNA that forms a secondary structure comprising at least two single stranded loops; and/or
        iv) a sequence that has greater than 60% G-C content;
    wherein, during the synthesis, at least one nucleotide incorporated into the oligonucleotide is a nucleotide analogue and/or a modified internucleotide linkage is incorporated between at least two nucleotides.

26. The composition of claim 25, wherein the oligonucleotide has the sequence 5'X-Y-Z and at least one of features b), c) and d).

27. A composition comprising a cell and a single stranded oligonucleotide conjugated to a carrier, wherein the single stranded oligonucleotide is produced by a process comprising:
    synthesizing a single stranded oligonucleotide that:
    (a) has a sequence 5'-X-Y-Z, wherein X is any nucleotide, Y is a nucleotide sequence of 6 nucleotides in length that is not a seed sequence of a human microRNA, and Z is a nucleotide sequence of 1 to 8 nucleotides in length,
    (b) is 100% complementary with a PRC2-associated region of a human SMN gene, wherein the PRC2-associated region is a region of the SMN gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the SMN gene compared to a control sequencing reaction of products of a control RNA-immunoprecipitation assay that employs a control antibody, and
    (c) is 8 to 15 nucleotides in length,
    wherein, during the synthesis, at least one nucleotide incorporated into the oligonucleotide is a nucleotide analogue and/or a modified internucleotide linkage is incorporated between at least two nucleotides.

28. The composition of claim 27, wherein the carrier is a peptide.

29. The composition of claim 27, wherein the carrier is a steroid.

30. A pharmaceutical composition comprising a composition of claim 27 and a pharmaceutically acceptable carrier.

31. A kit comprising a container housing the composition of claim 27.

32. A method of increasing expression of SMN1 or SMN2 messenger RNA (mRNA) in a human cell, the method comprising:
    delivering a single stranded oligonucleotide into the cell, wherein the oligonucleotide does not induce substantial cleavage or degradation of the SMN1 or SMN2 mRNA in the cell and wherein the single stranded oligonucleotide is produced by a process comprising:
    synthesizing a single stranded oligonucleotide that:
    (a) has a sequence 5'-X-Y-Z, wherein X is any nucleotide, Y is a nucleotide sequence of 6 nucleotides in length that is not a seed sequence of a human microRNA, and Z is a nucleotide sequence of 1 to 8 nucleotides in length,
    (b) is 100% complementary with a PRC2-associated region of a human SMN gene, wherein the PRC2-associated region is a region of the SMN gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the SMN gene compared to a control sequencing reaction of products of a control RNA-immunoprecipitation assay that employs a control antibody, and (c) is 8 to 15 nucleotides in length, wherein, during the synthesis, at least one nucleotide incorporated into the oligonucleotide is a nucleotide analogue and/or a modified internucleotide linkage is incorporated between at least two nucleotides.

33. The method of claim 32, wherein delivery of the single stranded oligonucleotide into the cell results in a level of expression of SMN1 or SMN2 mRNA that is at least 50% greater than a level of expression of SMN1 or SMN2 mRNA in a control cell that does not comprise the single stranded oligonucleotide.

34. A method of increasing expression of SMN2 messenger RNA (mRNA) in a human cell, the method comprising:
 delivering to the cell a first single stranded oligonucleotide complementary with at least 8 consecutive nucleotides of a PRC2-associated region of human SMN2 and a second single stranded oligonucleotide complementary with at least 8 consecutive nucleotides of a splice control sequence of a precursor mRNA of human SMN2, in amounts sufficient to increase expression of a mature mRNA of SMN2 that comprises exon 7 in the cell, wherein the first and second oligonucleotides do not induce substantial cleavage or degradation of SMN2 mRNA in the cell.

35. The method of claim 34, wherein the first single stranded oligonucleotide is covalently linked to the second single stranded oligonucleotide through a linker.

36. A composition comprising:
 a first single stranded oligonucleotide produced by a process comprising synthesizing a single stranded oligonucleotide that is complementary with at least 8 consecutive nucleotides of a PRC2-associated region of a human SMN2 gene, wherein the PRC2-associated region is a region of the SMN2 gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the SMN2 gene compared to a control sequencing reaction of products of a control RNA-immunoprecipitation assay that employs a control antibody, and a second single stranded oligonucleotide complementary with at least 9 consecutive nucleotides of a splice control sequence of a precursor mRNA encoded by the SMN2 gene.

37. The composition of claim 36, wherein the first single stranded oligonucleotide is covalently linked to the second single stranded oligonucleotide through a linker.

38. The composition of claim 36, wherein the first and/or single stranded oligonucleotide comprises at least one nucleotide analogue and/or a modified internucleotide linkage between at least two nucleotides.

* * * * *

UNITED STATES PATENT AND TRADEMARK OFFICE
CERTIFICATE OF CORRECTION

PATENT NO. : 10,059,941 B2
APPLICATION NO. : 14/401194
DATED : August 28, 2018
INVENTOR(S) : Arthur M. Krieg et al.

Page 1 of 1

It is certified that error appears in the above-identified patent and that said Letters Patent is hereby corrected as shown below:

In the Specification

At Column 1, Line 23, before the paragraph titled FIELD OF THE INVENTION, please insert the following paragraph:
--GOVERNMENT SUPPORT
This invention was made with Government support under Grant No. R01-GM-090278 awarded by the National Institutes of Health. The Government has certain rights in the invention.--

Signed and Sealed this
Eleventh Day of December, 2018

Andrei Iancu
*Director of the United States Patent and Trademark Office*